(12) United States Patent
Gill et al.

(10) Patent No.: US 9,982,279 B1
(45) Date of Patent: May 29, 2018

(54) NUCLEIC ACID-GUIDED NUCLEASES

(71) Applicant: Inscripta, Inc., Boulder, CO (US)

(72) Inventors: Ryan T. Gill, Denver, CO (US);
Andrew Garst, Boulder, CO (US);
Tanya Elizabeth Warnecke Lipscomb, Boulder, CO (US)

(73) Assignee: Inscripta, Inc., Boulder, CO (US)

( * ) Notice: Subject to any disclaimer, the term of this patent is extended or adjusted under 35 U.S.C. 154(b) by 0 days. days.

(21) Appl. No.: 15/632,001

(22) Filed: Jun. 23, 2017

(51) Int. Cl.
| | |
|---|---|
| *C12N 15/90* | (2006.01) |
| *C12N 15/11* | (2006.01) |
| *C12N 15/10* | (2006.01) |
| *C12N 15/85* | (2006.01) |
| *C12N 9/22* | (2006.01) |
| *C12N 5/10* | (2006.01) |
| *C12N 5/14* | (2006.01) |
| *C12N 5/16* | (2006.01) |
| *C12N 5/22* | (2006.01) |
| *C12N 15/09* | (2006.01) |
| *C12N 15/52* | (2006.01) |
| *C12N 15/63* | (2006.01) |
| *C12N 15/79* | (2006.01) |
| *C12N 15/70* | (2006.01) |
| *C12N 15/81* | (2006.01) |

(52) U.S. Cl.
CPC ............ *C12N 15/902* (2013.01); *C12N 9/22* (2013.01); *C12N 15/11* (2013.01); *C12N 15/70* (2013.01); *C12N 15/81* (2013.01); *C12N 15/85* (2013.01); *C12N 15/905* (2013.01); *C12N 15/907* (2013.01); *C12N 2310/20* (2017.05); *C12N 2800/22* (2013.01)

(58) Field of Classification Search
None
See application file for complete search history.

(56) References Cited

U.S. PATENT DOCUMENTS

| | | |
|---|---|---|
| 6,322,969 B1 | 11/2001 | Stull et al. |
| 6,562,594 B1 | 5/2003 | Short |
| 8,153,432 B2 | 4/2012 | Church et al. |
| 8,569,041 B2 | 10/2013 | Church et al. |
| 8,697,359 B1 | 4/2014 | Zhang |
| 8,906,616 B2 | 12/2014 | Zhang et al. |
| 9,458,439 B2 | 10/2016 | Choulika et al. |
| 2008/0287317 A1 | 11/2008 | Boone |
| 2009/0176653 A1 | 7/2009 | Kim et al. |
| 2010/0034924 A1 | 2/2010 | Fremaux et al. |
| 2010/0305001 A1 | 12/2010 | Kern et al. |
| 2014/0068797 A1 | 3/2014 | Doudna et al. |
| 2014/0089681 A1 | 3/2014 | Goto et al. |
| 2014/0121118 A1 | 5/2014 | Warner |
| 2014/0199767 A1 | 7/2014 | Barrangou et al. |
| 2014/0273226 A1 | 9/2014 | Wu |
| 2014/0273232 A1 | 9/2014 | Zhang et al. |
| 2014/0295557 A1 | 10/2014 | Joung et al. |
| 2015/0031133 A1 | 1/2015 | Church et al. |
| 2015/0031134 A1 | 1/2015 | Zhang et al. |
| 2015/0064138 A1 | 3/2015 | Lu et al. |
| 2015/0079680 A1 | 3/2015 | Bradley et al. |
| 2015/0098954 A1 | 4/2015 | Hyde et al. |
| 2015/0133315 A1 | 5/2015 | Jacobson et al. |
| 2015/0159174 A1 | 6/2015 | Frendewey et al. |
| 2015/0176013 A1 | 6/2015 | Musunuru et al. |
| 2015/0201634 A1 | 7/2015 | Fremaux et al. |
| 2015/0225773 A1 | 8/2015 | Farmer et al. |
| 2015/0247150 A1 | 9/2015 | Zhang et al. |
| 2015/0353905 A1 | 12/2015 | Weiss et al. |
| 2015/0353917 A1 | 12/2015 | Miller |
| 2015/0368639 A1 | 12/2015 | Gill et al. |
| 2016/0024523 A1 | 1/2016 | Joung et al. |
| 2016/0024529 A1 | 1/2016 | Carstens |
| 2016/0053272 A1 | 2/2016 | Wurtzel et al. |
| 2016/0053304 A1 | 2/2016 | Wurtzel et al. |
| 2016/0060653 A1 | 3/2016 | Doudna et al. |
| 2016/0060654 A1 | 3/2016 | Doudna et al. |
| 2016/0068864 A1 | 3/2016 | Doudna et al. |
| 2016/0076093 A1 | 3/2016 | Shendure et al. |
| 2016/0102322 A1 | 4/2016 | Ravinder et al. |
| 2016/0115488 A1 | 4/2016 | Zhang et al. |

(Continued)

FOREIGN PATENT DOCUMENTS

| | | |
|---|---|---|
| EP | 2764103 A2 | 8/2014 |
| EP | 2825654 A1 | 1/2015 |

(Continued)

OTHER PUBLICATIONS

NCBI (https://www.ncbi.nlm.nih.gov/protein/WP_055225123?report=genbank&log$=protalign&blast_rank=1&RID=5FPJ4MN4014, Type V CRISPR—associated protein Cpf1 Eubacterium rectale, 2016).*
Abudayyeh, et al. C2c2 is a single-component programmable RNA-guided RNA-targeting CRISPR effector. Science. Jun. 2, 2016. DOI: 10.1126/science.aaf557.
Agresti, et al. Ultrahigh-throughput screening in drop-based microfluidics for directed evolution. Proc Natl Acad Sci U S A. Mar. 2, 2010;107(9):4004-9. doi: 10.1073/pnas.0910781107. Epub Feb. 8, 2010.
Alper, et al. Engineering yeast transcription machinery for improved ethanol tolerance and production. Science. Dec. 8, 2006;314(5805):1565-8.
Alper, et al. Global transcription machinery engineering: a new approach for improving cellular phenotype. Metab Eng. May 2007;9(3):258-67. Epub Jan. 8, 2007.

(Continued)

*Primary Examiner* — Julie Wu
(74) *Attorney, Agent, or Firm* — Wilson Sonsini Goodrich & Rosati

(57) ABSTRACT

Disclosed herein are nucleic acid-guided nucleases, guide nucleic acids, and targetable nuclease systems, and methods of use. Disclosed herein are engineered non-naturally occurring nucleic acid-guided nucleases, guide nucleic acids, and targetable nuclease systems, and methods of use. Targetable nuclease systems can be used to edit genetic targets, including recursive genetic engineering and trackable genetic engineering methods.

17 Claims, 21 Drawing Sheets
(21 of 21 Drawing Sheet(s) Filed in Color)

(56) References Cited

U.S. PATENT DOCUMENTS

| | | | |
|---|---|---|---|
| 2016/0115489 | A1 | 4/2016 | Zhang et al. |
| 2016/0160210 | A1 | 6/2016 | Mali et al. |
| 2016/0168592 | A1 | 6/2016 | Church et al. |
| 2016/0186168 | A1 | 6/2016 | Konieczka et al. |
| 2016/0208243 | A1 | 7/2016 | Zhang et al. |
| 2016/0264995 | A1 | 9/2016 | Yamamoto et al. |
| 2016/0289673 | A1 | 10/2016 | Huang et al. |
| 2016/0289675 | A1 | 10/2016 | Ryan et al. |
| 2016/0298096 | A1 | 10/2016 | Charpentier et al. |
| 2016/0298097 | A1 | 10/2016 | Chavez et al. |
| 2016/0298134 | A1 | 10/2016 | Chen et al. |
| 2016/0298135 | A1 | 10/2016 | Chen et al. |
| 2016/0298138 | A1 | 10/2016 | Chen et al. |
| 2016/0333389 | A1 | 11/2016 | Liu et al. |
| 2016/0367702 | A1 | 12/2016 | Hoge et al. |
| 2017/0002339 | A1 | 1/2017 | Barrangou et al. |
| 2017/0037434 | A1 | 2/2017 | Choulika et al. |
| 2017/0044569 | A9 | 2/2017 | Church et al. |
| 2017/0051276 | A1 | 2/2017 | May et al. |
| 2017/0051310 | A1 | 2/2017 | Doudna et al. |
| 2017/0051311 | A1 | 2/2017 | Dalia et al. |
| 2017/0058272 | A1 | 3/2017 | Carter et al. |
| 2017/0067046 | A1 | 3/2017 | Gill et al. |
| 2017/0073705 | A1 | 3/2017 | Chen et al. |
| 2017/0080107 | A1 | 3/2017 | Chivukula et al. |
| 2017/0114334 | A1 | 4/2017 | May et al. |
| 2017/0114369 | A1 | 4/2017 | Donohoue et al. |
| 2017/0145425 | A1 | 5/2017 | Kim et al. |
| 2017/0159045 | A1 | 6/2017 | Serber et al. |
| 2017/0175143 | A1 | 6/2017 | Tolar et al. |
| 2017/0191123 | A1 | 7/2017 | Kim et al. |
| 2017/0198302 | A1 | 7/2017 | Feng et al. |
| 2017/0204407 | A1 | 7/2017 | Gilbert et al. |
| 2017/0211142 | A1 | 7/2017 | Smargon et al. |
| 2017/0218349 | A1 | 8/2017 | Miller et al. |
| 2017/0226533 | A1 | 8/2017 | Frisch et al. |
| 2017/0233752 | A1 | 8/2017 | Shiboleth et al. |
| 2017/0233756 | A1 | 8/2017 | Begemann et al. |
| 2017/0240922 | A1 | 8/2017 | Gill et al. |
| 2017/0369870 | A1* | 12/2017 | Gill .................... C12N 15/1065 |

FOREIGN PATENT DOCUMENTS

| | | |
|---|---|---|
| EP | 2828386 A1 | 1/2015 |
| EP | 2840140 A1 | 2/2015 |
| EP | 2848690 A1 | 3/2015 |
| EP | 2898075 A1 | 7/2015 |
| EP | 3009511 A2 | 4/2016 |
| EP | 3064585 A1 | 9/2016 |
| EP | 2840140 B1 | 11/2016 |
| EP | 3144390 A1 | 3/2017 |
| EP | 3009511 B1 | 5/2017 |
| WO | WO-03106654 A2 | 12/2003 |
| WO | WO-2007144770 A2 | 12/2007 |
| WO | WO-2012142591 A2 | 10/2012 |
| WO | WO-2013176772 A1 | 11/2013 |
| WO | WO-2013176915 A1 | 11/2013 |
| WO | WO-2014022702 A2 | 2/2014 |
| WO | WO-2014065596 A1 | 5/2014 |
| WO | WO-2014093595 A1 | 6/2014 |
| WO | WO-2014093661 A2 | 6/2014 |
| WO | WO-2014099744 A1 | 6/2014 |
| WO | WO-2014110006 A1 | 7/2014 |
| WO | WO-2014143381 A1 | 9/2014 |
| WO | WO-2014150624 A1 | 9/2014 |
| WO | WO-2014191128 A1 | 12/2014 |
| WO | WO-2015006290 A1 | 1/2015 |
| WO | WO-2015006747 A2 | 1/2015 |
| WO | WO-2015013583 A2 | 1/2015 |
| WO | WO-2015017866 A1 | 2/2015 |
| WO | WO-2015048577 A2 | 4/2015 |
| WO | WO-2015048690 A1 | 4/2015 |
| WO | WO-2015068785 A1 | 5/2015 |
| WO | WO-2015069682 A2 | 5/2015 |
| WO | WO-2015070062 A1 | 5/2015 |
| WO | WO-2015071474 A2 | 5/2015 |
| WO | WO-2015089354 A1 | 6/2015 |
| WO | WO-2015123339 A1 | 8/2015 |
| WO | WO-2015153889 A2 | 10/2015 |
| WO | WO-2015159086 A1 | 10/2015 |
| WO | WO-2015159087 A1 | 10/2015 |
| WO | WO-2015179540 A1 | 11/2015 |
| WO | WO-2015191693 A2 | 12/2015 |
| WO | WO-2015195798 A1 | 12/2015 |
| WO | WO-2015198020 A1 | 12/2015 |
| WO | WO-2015191693 A3 | 2/2016 |
| WO | WO-2016040594 A1 | 3/2016 |
| WO | WO-2016070037 A2 | 5/2016 |
| WO | WO-2016099887 A1 | 6/2016 |
| WO | WO-2016100955 A2 | 6/2016 |
| WO | WO-2016106239 A1 | 6/2016 |
| WO | WO-2016166340 A1 | 10/2016 |
| WO | WO-2016186946 A1 | 11/2016 |
| WO | WO-2016186953 A1 | 11/2016 |
| WO | WO-2016196805 A1 | 12/2016 |
| WO | WO-2016205554 A1 | 12/2016 |
| WO | WO-2016205613 A1 | 12/2016 |
| WO | WO-2016205749 A1 | 12/2016 |
| WO | WO-2016205764 A1 | 12/2016 |
| WO | WO-2017004261 A1 | 1/2017 |
| WO | WO-2017015015 A1 | 1/2017 |
| WO | WO-2017019867 A1 | 2/2017 |
| WO | WO-2017031483 A1 | 2/2017 |
| WO | WO-2017053713 A1 | 3/2017 |
| WO | WO-2017066588 A2 | 4/2017 |
| WO | WO-2017068120 A1 | 4/2017 |
| WO | WO-2017070605 A1 | 4/2017 |
| WO | WO-2017089767 A1 | 6/2017 |
| WO | WO-2017099494 A1 | 6/2017 |
| WO | WO-2017100343 A1 | 6/2017 |
| WO | WO-2017100377 A1 | 6/2017 |
| WO | WO-2017109167 A2 | 6/2017 |
| WO | WO-2017127807 A1 | 7/2017 |
| WO | WO-2017223538 A1 | 12/2017 |

OTHER PUBLICATIONS

Baba, et al. Construction of *Escherichia coli* K-12 in-frame, single-gene knockout mutants: the Keio collection. Mol Syst Biol. 2006;2:2006.0008. Epub Feb. 21, 2006.

Bakan, et al. ProDy: protein dynamics inferred from theory and experiments. Bioinformatics. Jun. 1, 2011;27(11):1575-7. doi: 10.1093/bioinformatics/btr168. Epub Apr. 5, 2011.

Basak, et al. Enhancing *E. coli* tolerance towards oxidative stress via engineering its global regulator cAMP receptor protein (CRP). PLoS One. 2012;7(12):e51179. doi: 10.1371/journal.pone.0051179. Epub Dec. 14, 2012.

Bateman, et al. The Pfam protein families database. Nucleic Acids Res. Jan. 1, 2004;32(Database issue):D138-41.

Bhabha, et al. Divergent evolution of protein conformational dynamics in dihydrofolate reductase. Nat Struct Mol Biol. Nov. 2013;20(11):1243-9. doi: 10.1038/nsmb.2676. Epub Sep. 29, 2013.

Bhaya, et al. CRISPR-Cas systems in bacteria and archaea: versatile small RNAs for adaptive defense and regulation. Annu Rev Genet. 2011;45:273-97. doi: 10.1146/annurev-genet-110410-132430.

Bikard, et al. CRISPR interference can prevent natural transformation and virulence acquisition during in vivo bacterial infection. Cell Host Microbe. Aug. 16, 2012;12(2):177-86. doi: 10.1016/j.chom.2012.06.003.

Boehr, et al. The dynamic energy landscape of dihydrofolate reductase catalysis. Science. Sep. 15, 2006;313(5793):1638-42.

Brouns, et al. Small CRISPR RNAs guide antiviral defense in prokaryotes. Science. Aug. 15, 2008;321(5891):960-4. doi: 10.1126/science.1159689.

Browning, et al. Modulation of CRP-dependent transcription at the *Escherichia coli* acsP2 promoter by nucleoprotein complexes: anti-activation by the nucleoid proteins FIS and IHF. Mol Microbiol. Jan. 2004;51(1):241-54.

Campbell, et al. Structural mechanism for rifampicin inhibition of bacterial rna polymerase. Cell. Mar. 23, 2001;104(6):901-12.

(56) References Cited

OTHER PUBLICATIONS

Chang, et al. Structural systems biology evaluation of metabolic thermotolerance in *Escherichia coli*. Science. Jun. 7, 2013;340(6137):1220-3. doi: 10.1126/science.1234012.
Chen, et al. Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chiang, et al. Regulators of oxidative stress response genes in *Escherichia coli* and their functional conservation in bacteria. Arch Biochem Biophys. Sep. 15, 2012;525(2):161-9. doi: 10.1016/j.abb.2012.02.007. Epub Feb. 20, 2012.
Cong, et al. Multiplex genome engineering using CRISPR/Cas systems. Science. Feb. 15, 2013;339(6121):819-23. doi: 10.1126/science.1231143. Epub Jan. 3, 2013.
Co-pending U.S. Appl. No. 15/116,616, filed Aug. 4, 2016.
Co-pending U.S. Appl. No. 15/630,909, filed Jun. 22, 2017.
Co-pending U.S. Appl. No. 15/631,989, filed Jun. 23, 2017.
Co-pending U.S. Appl. No. 15/632,222, filed Jun. 23, 2017.
Costantino, et al. Enhanced levels of lambda Red-mediated recombinants in mismatch repair mutants. Proc Natl Acad Sci U S A. Dec. 23, 2003;100(26):15748-53. Epub Dec. 12, 2003.
Datta, et al. A set of recombineering plasmids for gram-negative bacteria. Gene. Sep. 1, 2006;379:109-15. Epub May 4. 2006.
DiCarlo, et al. Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dwyer, et al. Role of reactive oxygen species in antibiotic action and resistance. Curr Opin Microbiol. Oct. 2009;12(5):482-9. doi: 10.1016/j.mib.2009.06.018. Epub Jul. 31, 2009.
Ebright, et al. Consensus DNA site for the *Escherichia coli* catabolite gene activator protein (CAP): CAP exhibits a 450-fold higher affinity for the consensus DNA site than for the *E. coli* lac DNA site. Nucleic Acids Res. Dec. 25, 1989;17(24):10295-305.
Edgar. Search and clustering orders of magnitude faster than BLAST. Bioinformatics. Oct. 1, 2010;26(19):2460-1. doi: 10.1093/bioinformatics/btq461. Epub Aug. 12, 2010.
Eklund, et al. Altered target site specificity variants of the I-Ppol His-Cys box homing endonuclease. Nucleic Acids Res. 2007;35(17):5839-50. Epub Aug. 24, 2007.
European Search Report dated Jun. 26, 2017 for EP Application No. 15749644.9.
Farasat, et al. Efficient search, mapping, and optimization of multi-protein genetic systems in diverse bacteria. Mol Syst Biol. Jun. 21, 2014;10:731. doi: 10.15252/msb.20134955.
Findlay, et al. Saturation editing of genomic regions by multiplex homology-directed repair. Nature. Sep. 4, 2014;513(7516):120-3. doi: 10.1038/nature13695.
Firth, et al. GLUE-IT and PEDEL-AA: new programmes for analyzing protein diversity in randomized libraries. Nucleic Acids Res. Jul. 1, 2008;36(Web Server issue):W281-5. doi: 10.1093/nar/gkn226. Epub Apr. 28, 2008.
Fisher, et al. Enhancing tolerance to short-chain alcohols by engineering the *Escherichia coli* AcrB efflux pump to secrete the non-native substrate n-butanol. ACS Synth Biol. Jan. 17, 2014;3(1):30-40. doi: 10.1021/sb400065q. Epub Sep. 13, 2013.
Foo, et al. Directed evolution of an *E. coli* inner membrane transporter for improved efflux of biofuel molecules. Biotechnol Biofuels. May 21, 2013;6(1):81. doi: 10.1186/1754-6834-6-81.
Gao, et al. DNA-guided genome editing using the Natronobacterium gregoryi Argonaute. Nat Biotechnol. May 2, 2016. doi: 10.1038/nbt.3547.
Garst, et al., Genome-wide mapping of mutations at single-nucleotide resolution for protein, metabolic and genome engineering. Nature Biotechnology 35, 48-55 (2017) doi:10.1038/nbt.3718.
Garst, et al., Strategies for the multiplex mapping of genes to traits. Microbial Cell Factories 2013, 12:99.
Glebes, et al. Comparison of genome-wide selection strategies to identify furfural tolerance genes in *Escherichia coli*. Biotechnol Bioeng. Jan. 2015;112(1):129-40. doi: 10.1002/bit.25325. Epub Sep. 2, 2014.
Gutierrez-Rios, et al. Regulatory network of *Escherichia coli*: consistency between literature knowledge and microarray profiles. Genome Res. Nov. 2003;13(11):2435-43.
Hamady, et al. Error-correcting barcoded primers for pyrosequencing hundreds of samples in multiplex. Nat Methods. Mar. 2008;5(3):235-7. doi: 10.1038/nmeth.1184. Epub Feb. 10, 2008.
HHMI. The Fields lab homepage. Cloning Vectors. Available at http://depts.washington.edu/sfields/protocols/pOAD.html. Accessed on Jan. 3, 2017.
Ho, et al. Efficient Reassignment of a Frequent Serine Codon in Wild-Type *Escherichia coli*. ACS Synth Biol. Feb. 19, 2016;5(2):163-71. doi: 10.1021/acssynbio.5b00197. Epub Nov. 20, 2015.
Hung, et al. Crystal structure of AcrB complexed with linezolid at 3.5 Å resolution. J Struct Funct Genomics. Jun. 2013;14(2):71-5. doi: 10.1007/s10969-013-9154-x. Epub May 15, 2013.
Hwang, et al. Efficient genome editing in zebrafish using a CRISPR-Cas system. Nat Biotechnol. Mar. 2013;31(3):227-9. doi: 10.1038/nbt.2501. Epub Jan. 29, 2013.
Ibanez, et al. Mass spectrometry-based metabolomics of single yeast cells. Proc Natl Acad Sci U S A. May 28, 2013;110(22):8790-4. doi: 10.1073/pnas.1209302110. Epub May 13, 2013.
International search report and written opinion dated Jul. 28, 2015 for PCT/US2015/015476.
International search report and written opinion dated Nov. 5, 2012 for PCT/US2012/033799.
Isaacs, et al. Precise manipulation of chromosomes in vivo enables genome-wide codon replacement. Science. Jul. 15, 2011;333(6040):348-53. doi: 10.1126/science.1205822.
Iwakura, et al. Evolutionary design of a hyperactive cysteine- and methionine-free mutant of *Escherichia coli* dihydrofolate reductase. J Biol Chem. May 12, 2006;281(19):13234-46. Epub Mar. 1, 2006.
Jiang, et al. Multigene editing in the *Escherichia coli* genome via the CRISPR-Cas9 system. Appl Environ Microbiol. Apr. 2015;81(7):2506-14. doi: 10.1128/AEM.04023-14. Epub Jan. 30, 2015.
Jiang, et al. RNA-guided editing of bacterial genomes using CRISPR-Cas systems. Nat Biotechnol. Mar. 2013;31(3):233-9. doi: 10.1038/nbt.2508. Epub Jan. 29, 2013.
Jinek, et al. A programmable dual-RNA-guided DNA endonuclease in adaptive bacterial immunity. Science. Aug. 17, 2012;337(6096):816-21. doi: 10.1126/science.1225829. Epub Jun. 28, 2012.
Kersten, et al. A mass spectrometry-guided genome mining approach for natural product peptidogenomics. Nat Chem Biol. Oct. 9, 2011;7(11):794-802. doi: 10.1038/nchembio.684.
Kim, et al. A guide to genome engineering with programmable nucleases. Nat Rev Genet. May 2014;15(5):321-34. doi: 10.1038/nrg3686. Epub Apr. 2, 2014.
Kim, et al. Hybrid restriction enzymes: zinc finger fusions to Fok I cleavage domain. Proc Natl Acad Sci U S A. Feb. 6, 1996;93(3):1156-60.
Kleinstiver, et al., Engineered CRISPR-Cas9 nucleases with altered PAM specificities. Nature. Jul. 23, 2015; 523 (7561): 481-5. doi: 10.1038/nature14592.
Kohanski, et al. A common mechanism of cellular death induced by bactericidal antibiotics. Cell. Sep. 7, 2007;130(5):797-810.
Kosuri, et al. Scalable gene synthesis by selective amplification of DNA pools from high-fidelity microchips. Nat Biotechnol. Dec. 2010;28(12):1295-9. doi: 10.1038/nbt.1716. Epub Nov. 28, 2010.
Kwon, et al. Crystal structure of the *Escherichia coli* Rob transcription factor in complex with DNA. Nat Struct Biol. May 2000;7(5):424-30.
Lajoie, et al. Genomically recoded organisms expand biological functions. Science. Oct. 18, 2013;342(6156):357-60. doi: 10.1126/science.1241459.
Li, et al. Identification of factors influencing strand bias in oligonucleotide-mediated recombination in *Escherichia coli*. Nucleic Acids Res. Nov. 15, 2003;31(22):6674-87.
Li, et al. Metabolic engineering of *Escherichia coli* using CRISPR-Cas9 meditated genome editing. Metab Eng. Sep. 2015;31:13-21. doi: 10.1016/j.ymben.2015.06.006. Epub Jun. 30, 2015.

(56) References Cited

OTHER PUBLICATIONS

Liu, et al. Efficient genome editing in filamentous fungus *Trichoderma reesei* using the CRISPR/Cas9 system. Cell Discovery. 2015; 1:15007. doi:10.1038/celldisc.2015.7.
Makarova et al. An updated evolutionary classification of CRISPR-Cas systems. Nat Rev Microbiol 13:722-736 (2015).
Makarova, et al. Evolution and classification of the CRISPR-Cas systems. Nat Rev Microbiol. Jun. 2011;9(6):467-77. doi: 10.1038/nrmicro2577. Epub May 9, 2011.
Mali, et al. RNA-guided human genome engineering via Cas9. Science. Feb. 15, 2013;339(6121):823-6. doi: 10.1126/science.1232033. Epub Jan. 3, 2013.
Maruyama, et al. Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Mills, et al. Cellulosic hydrolysate toxicity and tolerance mechanisms in *Escherichia coli*. Biotechnol Biofuels. Oct. 15, 2009;2:26. doi: 10.1186/1754-6834-2-26.
Molodtsov, et al. X-ray crystal structures of the *Escherichia coli* RNA polymerase in complex with benzoxazinorifamycins. J Med Chem. Jun. 13, 2013;56(11):4758-63. doi: 10.1021/jm4004889. Epub May 31, 2013.
Murakami, et al. Structural basis of transcription initiation: RNA polymerase holoenzyme at 4 A resolution. Science. May 17, 2002;296(5571):1280-4.
Nakashima, et al. Structural basis for the inhibition of bacterial multidrug exporters. Nature. Aug. 1, 2013;500(7460):102-6. doi: 10.1038/nature12300. Epub Jun. 30, 2013.
Nakashima, et al. Structures of the multidrug exporter AcrB reveal a proximal multisite drug-binding pocket. Nature. Nov. 27, 2011;480(7378):565-9. doi: 10.1038/nature10641.
NCBI. Basic Local Alignment Search Tool. Available at https://blast.ncbi.nlm.nih.gov/Blast.cgi. Accessed on Jan. 3, 2017.
Neylon, Cameron., Chemical and biochemical strategies for the randomization of protein encoding DNA sequences: library construction methods for directed evolution. Nucleic Acids Research, 2004, vol. 32, No. 4. 1448-1459.
Office Action dated Jun. 16, 2016 for U.S. Appl. No. 14/110,072.
Office Action dated Jun. 21, 2017 for U.S. Appl. No. 14/110,072.
Office Action dated Dec. 9, 2016 for U.S. Appl. No. 14/110,072.
Oh, et al. CRISPR-Cas9-assisted recombineering in Lactobacillus reuteri. Nucleic Acids Res. 2014;42(17):e131. doi: 10.1093/nar/gku623. Epub Jul. 29, 2014.
Pines, et al. Codon compression algorithms for saturation mutagenesis. ACS Synth Biol. May 15, 2015;4(5):604-14. doi: 10.1021/sb500282v. Epub Oct. 30, 2014.
Prior, et al. Broad-host-range vectors for protein expression across gram negative hosts. Biotechnol Bioeng. Jun. 1, 2010;106(2):326-32. doi: 10.1002/bit.22695.
Qi, et al. Repurposing CRISPR as an RNA-guided platform for sequence-specific control of gene expression. Cell. Feb. 28, 2013;152(5):1173-83. doi: 10.1016/j.cell.2013.02.022.
Raman, et al. Evolution-guided optimization of biosynthetic pathways. Proc Natl Acad Sci U S A. Dec. 16, 2014;111(50):17803-8. doi: 10.1073/pnas.1409523111. Epub Dec. 1, 2014.
Reynolds, et al. Quantifying Impact of Chromosome Copy Number on Recombination in *Escherichia coli*. ACS Synth Biol. Jul. 17, 2015;4(7):776-80. doi: 10.1021/sb500338g. Epub Mar. 19, 2015.
Rhee, et al. A novel DNA-binding motif in MarA: the first structure for an AraC family transcriptional activator. Proc Natl Acad Sci U S A. Sep. 1, 1998;95(18):10413-8.
Rice, et al. Crystal structure of an IHF-DNA complex: a protein-induced DNA U-turn. Cell. Dec. 27, 1996;87(7):1295-306.
Rodriguez-Verdugo, et al. Evolution of *Escherichia coli* rifampicin resistance in an antibiotic-free environment during thermal stress. BMC Evol Biol. Feb. 22, 2013;13:50. doi: 10.1186/1471-2148-13-50.
Ronda, et al. CRMAGE: CRISPR Optimized MAGE Recombineering. Sci Rep. Jan. 22, 2016;6:19452. doi: 10.1038/srep19452.
Ross, et al. A third recognition element in bacterial promoters: DNA binding by the alpha subunit of RNA polymerase. Science. Nov. 26, 1993;262(5138):1407-13.
Sandoval, et al. Strategy for directing combinatorial genome engineering in *Escherichia coli*. Proc Natl Acad Sci U S A. Jun. 26, 2012;109(26):10540-5. doi: 10.1073/pnas.1206299109. Epub Jun. 11, 2012.
Sawitzke, et al. Probing cellular processes with oligo-mediated recombination and using the knowledge gained to optimize recombineering. J Mol Biol. Mar. 18, 2011;407(1):45-59. doi: 10.1016/j.jmb.2011.01.030. Epub Jan. 19, 2011.
Semenova, et al. Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Shalem, et al. Genome-scale CRISPR-Cas9 knockout screening in human cells. Science. Jan. 3, 2014;343(6166):84-7. doi: 10.1126/science.1247005. Epub Dec. 12, 2013.
Shendure. Life after genetics. Genome Med. Oct. 29, 2014;6(10):86. doi: 10.1186/s13073-014-0086-2. eCollection 2014.
Shmakov et al. Discovery and Functional Characterization of Diverse Class 2 CRISPR-Cas Systems. Mol Cell 60(3):385-397 (2015).
Smanski, et al. Functional optimization of gene clusters by combinatorial design and assembly. Nat Biotechnol. Dec. 2014;32(12):1241-9. doi: 10.1038/nbt.3063. Epub Nov. 24, 2014.
Stearns, et al., Manipulating yeast genome using plasmid vectors. Methods in Enzymology. 1990, 185:280-297.
Steinmetz, et al. Maximizing the potential of functional genomics. Nat Rev Genet. Mar. 2004;5(3):190-201.
Stoebel, et al. Compensatory evolution of gene regulation in response to stress by *Escherichia coli* lacking RpoS. PLoS Genet. Oct. 2009;5(10):e1000671. doi: 10.1371/journal.pgen.1000671. Epub Oct. 2, 2009.
Swarts, et al. Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts, et al. DNA—guided DNA interference by a prokaryotic Argonaute. Nature. Mar. 13, 2014;507(7491):258-61. doi: 10.1038/nature12971. Epub Feb. 16, 2014.
Tenaillon, et al. The molecular diversity of adaptive convergence. Science. Jan. 27, 2012;335(6067):457-61. doi: 10.1126/science.1212986.
Toprak, et al. Evolutionary paths to antibiotic resistance under dynamically sustained drug selection. Nat Genet. Dec. 18, 2011;44(1)101-5. doi: 10.1038/ng.1034.
Waaijers, et al. CRISPR/Cas9-targeted mutagenesis in Caenorhabditis elegans. Genetics. Nov. 2013;195(3):1187-91. doi: 10.1534/genetics.113.156299. Epub Aug. 26, 2013.
Wang, et al. Engineering furfural tolerance in *Escherichia coli* improves the fermentation of lignocellulosic sugars into renewable chemicals. Proc Natl Acad Sci U S A. Mar. 5, 2013;110(10):4021-6. doi: 10.1073/pnas.1217958110. Epub Feb. 19, 2013.
Wang, et al. Genome-scale promoter engineering by coselection MAGE. Nat Methods. Jun. 2012;9(6):591-3. doi: 10.1038/nmeth.1971. Epub Apr. 8, 2012.
Wang, et al. Multiplexed in vivo His-tagging of enzyme pathways for in vitro single-pot multienzyme catalysis. ACS Synth Biol. Feb. 17, 2012;1(2):43-52.
Wang, et al. One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang, et al. Programming cells by multiplex genome engineering and accelerated evolution. Nature. Aug. 13, 2009;460(7257):894-8. doi: 10.1038/nature08187. Epub Jul. 26, 2009.
Warner, et al. Rapid profiling of a microbial genome using mixtures of barcoded oligonucleotides. Nat Biotechnol. Aug. 2010;28(8):856-62. doi: 10.1038/nbt.1653. Epub Jul. 18, 2010.
Watson, et al. Directed evolution of trimethoprim resistance in *Escherichia coli*. FEBS J. May 2007;274(10):2661-71. Epub Apr. 19, 2007.

(56) References Cited

OTHER PUBLICATIONS

Wetmore, et al. Rapid quantification of mutant fitness in diverse bacteria by sequencing randomly bar-coded transposons. MBio. May 12, 2015;6(3):e00306-15. doi: 10.1128/mBio.00306-15.

White, et al. Role of the acrAB locus in organic solvent tolerance mediated by expression of marA, soxS, or robA in *Escherichia coli*. J Bacteriol. Oct. 1997;179(19):6122-6.

"Withers, et al.Identification of isopentenol biosynthetic genes from Bacillus subtilis by a screening method based on isoprenoid precursor toxicity. Appl Environ Microbiol. Oct. 2007;73(19):6277-83. Epub Aug. 10, 2007".

Wolfe. The acetate switch. Microbiol Mol Biol Rev. Mar. 2005;69(1):12-50.

Zeitoun, et al. Multiplexed tracking of combinatorial genomic mutations in engineered cell populations. Nat Biotechnol. Jun. 2015;33(6):631-7. doi: 10.1038/nbt.3177. Epub Mar. 23, 2015.

Zetsche, et al. Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

Zhang, et al., Efficient editing of malaria parasite genome using the CRISPR/Cas9 system. mBio. Jul. 2014; vol. 5 Art. e01414-14.

Zhao, et al. Activity and specificity of the bacterial PD-(D/E)XK homing endonuclease I-Ssp6803I. J Mol Biol. Feb. 6, 2009;385(5):1498-510. doi: 10.1016/j.jmb.2008.10.096. Epub Nov. 12, 2008.

Zheng, et al. Metabolic engineering of *Escherichia coli* for high-specificity production of isoprenol and prenol as next generation of biofuels. Biotechnol Biofuels. Apr. 24, 2013;6:57. doi: 10.1186/1754-6834-6-57. eCollection 2013.

Examination Report dated Jun. 27, 2017 for GB Application No. 1615434.6.

"Dickinson et al. Engineering the Caenorhabditis elegans Genome Using Cas9-Triggered Homologous Recombination; Nat Methods. Oct. 2013; 10(10): 1028-1034; doi: 10.1038/nmeth.2641".

Hsu, et al., DNA targeting specificity of RNA-guided Cas9 nucleases. Nature Biotechnology. Jul. 21, 2013; 31(9): 827-834.

International Search Report dated Nov. 29, 2017 for International Patent Application No. PCT/US2017/039146.

International Search Report dated Dec. 26, 2017 for International Patent Application No. PCT/US2017/056344.

Office Action dated Jan. 19, 2018 for U.S. Appl. No. 15/631,989.
Office Action dated Oct. 3, 2017 for U.S. Appl. No. 15/631,989.
Office Action dated Nov. 8, 2017 for U.S. Appl. No. 15/630,909.
Office Action dated Nov. 20, 2017 for U.S. Appl. No. 15/632,222.

Plagens, et al., DNA and RNA interference mechanisms by CRISPR-Cas surveillance complexes, FEMS Microbiology Reviews, May 1, 2015; 39(3): 442-463.

\* cited by examiner

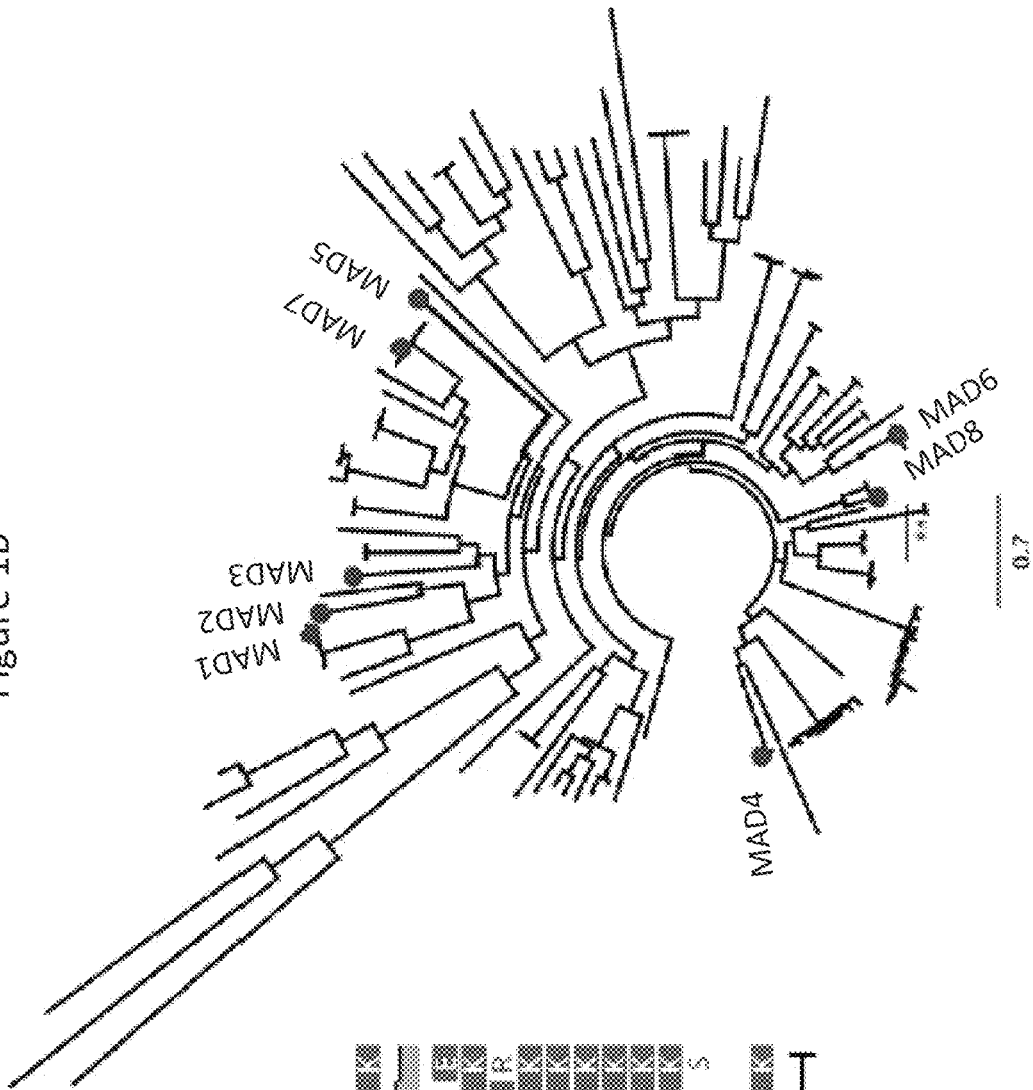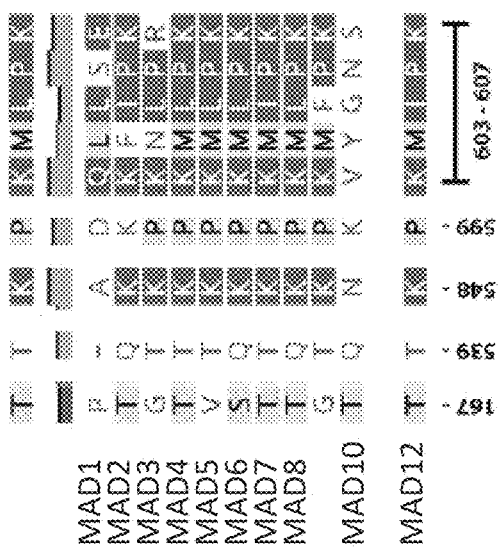
Figure 1A
Figure 1B

Screening/selection for gene edits
MAD nuclease vector
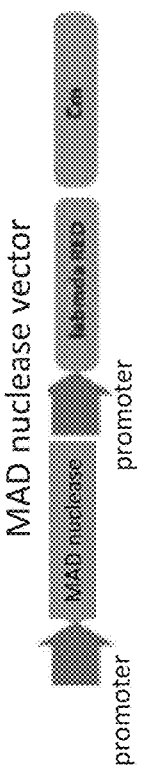
Figure 5A
Editing cassette
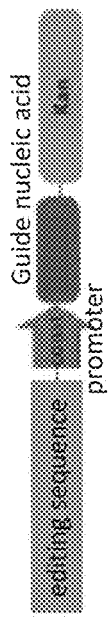
Figure 5B
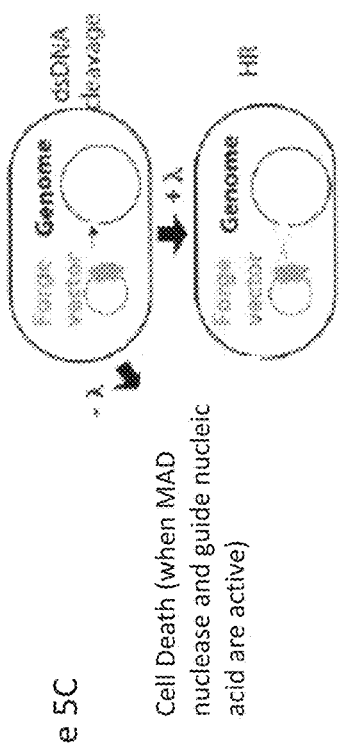
Figure 5C
Cell Death (when MAD nuclease and guide nucleic acid are active)
No Editing (when MAD nuclease and guide nucleic acid are inactive)
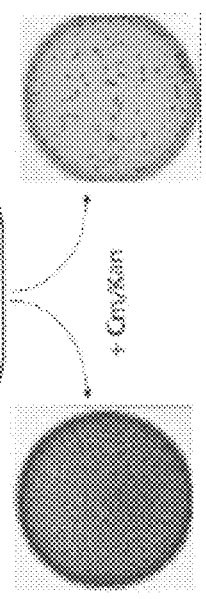
Editing (when MAD nuclease and guide nucleic acid are active and gene was successfully edited)

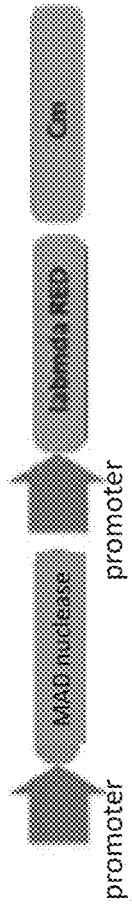
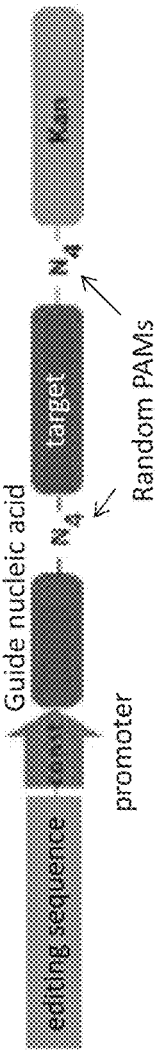
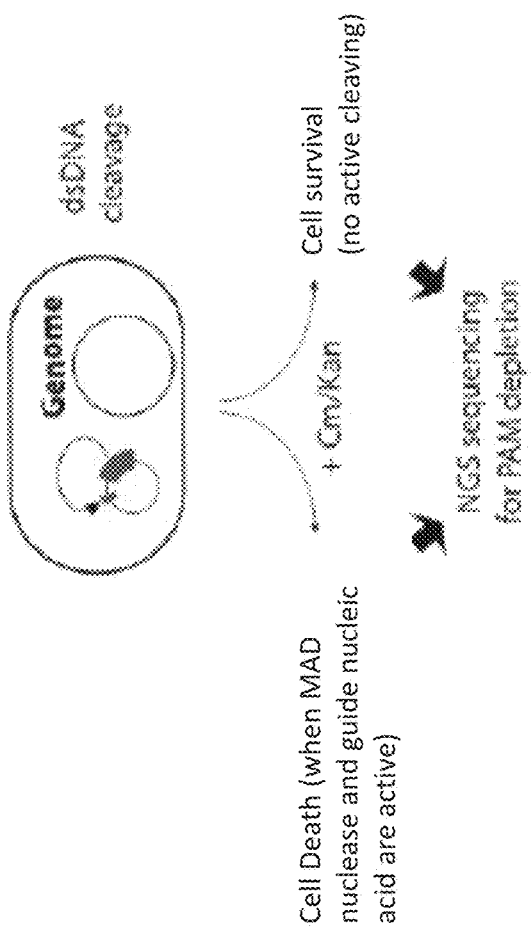
Figure 6A
Figure 6B
Figure 6C

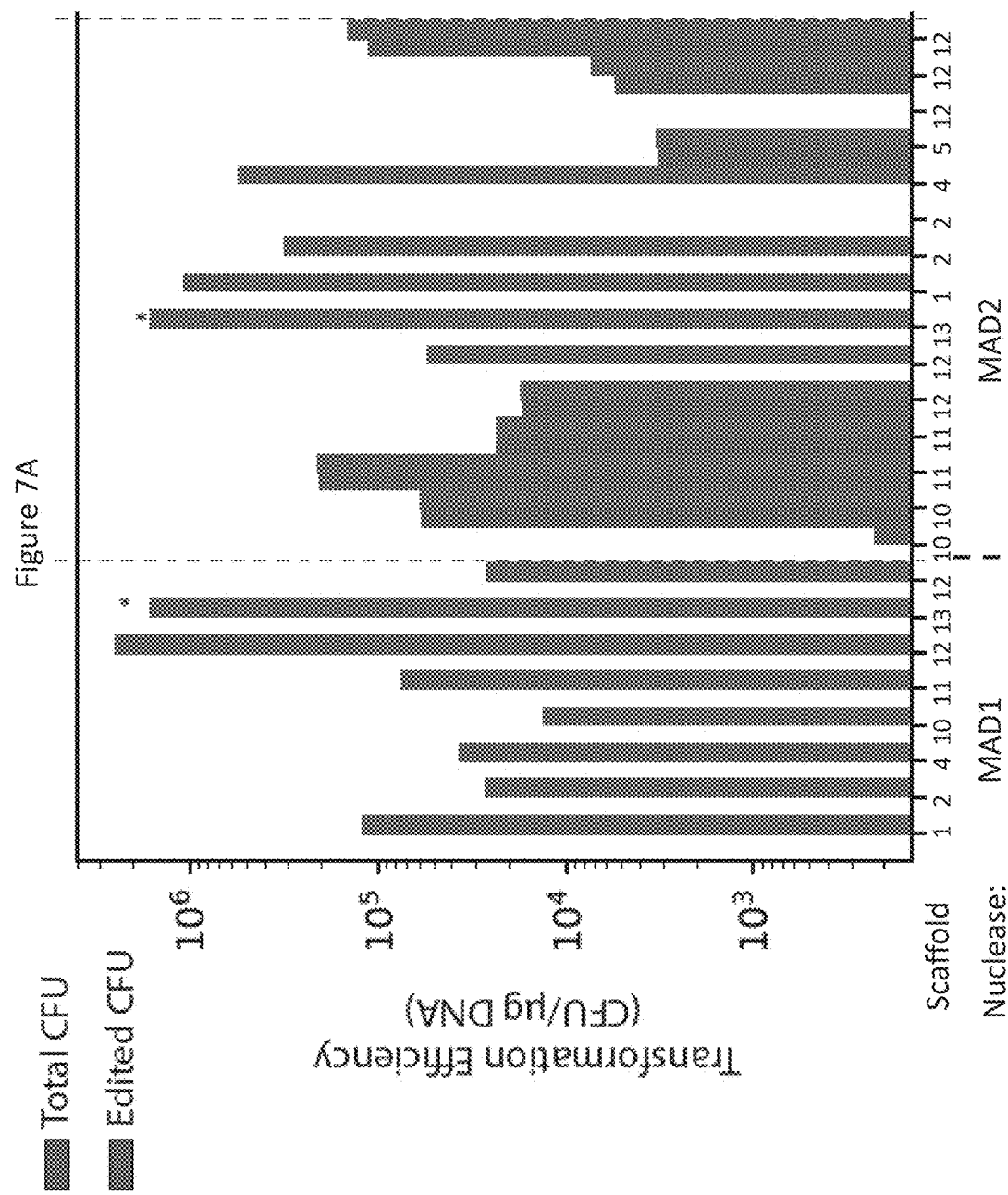

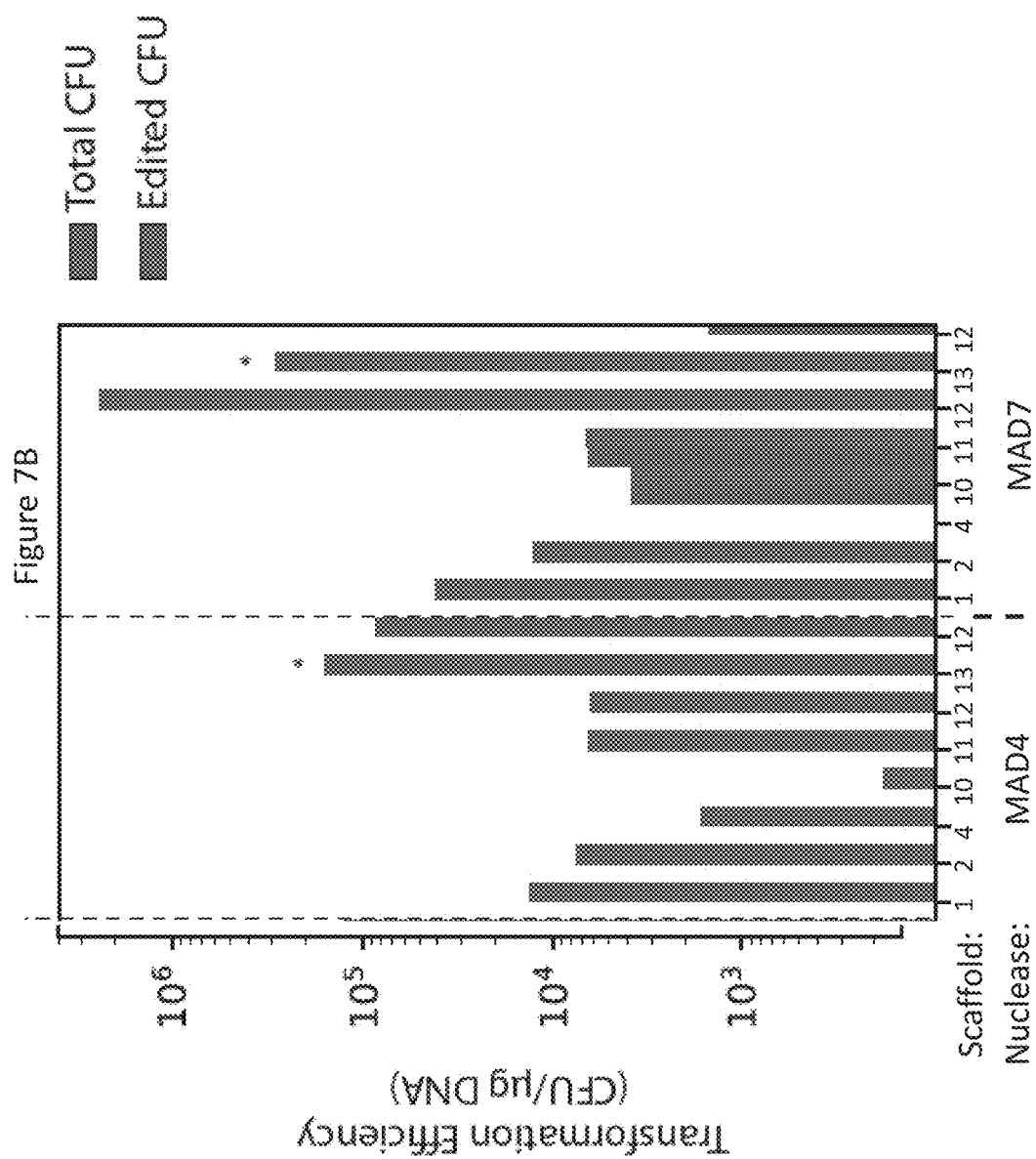

US 9,982,279 B1

NUCLEIC ACID-GUIDED NUCLEASES

BACKGROUND OF THE DISCLOSURE

Nucleic acid-guided nucleases have become important tools for research and genome engineering. The applicability of these tools can be limited by the sequence specificity requirements, expression, or delivery issues.

SEQUENCE LISTING

The instant application contains a Sequence Listing which has been submitted electronically in ASCII format and is hereby incorporated by reference in its entirety. Said ASCII copy, created on Jul. 14, 2017, is named 49022-717_201_SL.txt and is 809,754 bytes in size. This application contains a partial sequence list in Table 6.

SUMMARY OF THE DISCLOSURE

Disclosed herein are methods of modifying a target region in the genome of a cell, the method comprising: (a) contacting a cell with: a non-naturally occurring nucleic-acid-guided nuclease encoded by a nucleic acid having at least 80% identity to SEQ ID NO: 27; an engineered guide nucleic acid capable of complexing with the nucleic acid-guided nuclease; and an editing sequence encoding a nucleic acid complementary to said target region having a change in sequence relative to the target region; and (b) allowing the nuclease, guide nucleic acid, and editing sequence to create a genome edit in a target region of the genome of the cell. In some aspects, the engineered guide nucleic acid and the editing sequence are provided as a single nucleic acid. In some aspects, the single nucleic acid further comprises a mutation in a protospacer adjacent motif (PAM) site. In some aspects, the nucleic acid-guided nuclease is encoded by a nucleic acid with at least 85% identity to SEQ ID NO: 47. In some aspects, the nucleic acid-guided nuclease is encoded by a nucleic acid with at least 85% identity to SEQ ID NO: 133.

Disclosed herein are nucleic acid-guided nuclease systems comprising: (a) a non-naturally occurring nuclease encoded by a nucleic acid having at least 80% identity to SEQ ID NO: 27; (b) an engineered guide nucleic acid capable of complexing with the nucleic acid-guided nuclease, and (c) an editing sequence having a change in sequence relative to the sequence of a target region in a genome of a cell; wherein the system results in a genome edit in the target region in the genome of the cell facilitated by the nuclease, the engineered guide nucleic acid, and the editing sequence. In some aspects, nucleic acid-guided nuclease is encoded by a nucleic acid with at least 85% identity to SEQ ID NO: 47. In some aspects, the nucleic acid-guided nuclease is encoded by a nucleic acid with at least 85% identity to SEQ ID NO: 133. In some aspects, the nucleic acid-guided nuclease is codon optimized for the cell to be edited. In some aspects, the engineered guide nucleic acid and the editing sequence are provided as a single nucleic acid. In some aspects, the single nucleic acid further comprises a mutation in a protospacer adjacent motif (PAM) site.

Disclosed herein are compositions for use in genome editing comprising a non-naturally occurring nuclease encoded by a nucleic acid having at least 75% identity to SEQ ID NO: 27. In some aspects, the nucleic acid has at least 80% identity to SEQ ID NO: 27. In some aspects, the nucleic acid has at least 90% identity to SEQ ID NO: 27. In some aspects, the nuclease is further codon optimized for use in cells from a particular organism. In some aspects, the nuclease is codon optimized for E. Coli In some aspects, the nuclease is codon optimized for S. Cerevisiae. In some aspects, the nuclease is codon optimized for mammalian cells. In some aspects, the nucleic acid-guided nuclease has less than 40% protein identity to SEQ ID NO: 12. In some aspects, the nucleic acid-guided nuclease has less than 40% protein identity to SEQ ID NO: 108.

INCORPORATION BY REFERENCE

All publications and patent applications mentioned in this specification are herein incorporated by reference to the same extent as if each individual publication or patent application was specifically and individually indicated to be incorporated by reference.

BRIEF DESCRIPTION OF THE DRAWINGS

This patent or application file contains at least one drawing executed in color. Copies of this patent or patent application publication with color drawing(s) will be provided by the Office upon request and payment of the necessary fee.

FIG. 1A depicts a partial sequence alignment MAD1-8 (SEQ ID NO: 1-8) and MAD10-12 (SEQ ID NO: 10-12). FIG. 1A discloses residues 703-707 of SEQ ID NO: 1, residues 625-629 of SEQ ID NO: 2, residues 587-591 of SEQ ID NO: 3, residues 654-658 of SEQ ID NO: 4, residues 581-585 of SEQ ID NO: 5, residues 637-641 of SEQ ID NO: 6, residues 590-594 of SEQ ID NO: 7, residues 645-649 of SEQ ID NO: 8, SEQ ID NO: 205, residues 619-623 of SEQ ID NO: 10 and residues 603-607 of SEQ ID NO: 12, all disclosed respectively, in order of appearance.

FIG. 1B depicts a phylogenetic tree of nucleases including MAD1-8.

FIG. 2 discloses "6X-His" as SEQ ID NO: 182.

FIG. 3 discloses SEQ ID NOS 183-185, respectively, in order of appearance.

FIG. 5A depicts an example protein expression construct.
FIG. 5B depicts an example editing cassette.
FIG. 5C depicts an example screening or selection experiment workflow.

FIG. 6A depicts an example protein expression construct.
FIG. 6B depicts an example editing cassette.
FIG. 6C depicts an example screening or selection experiment workflow.

FIG. 7A-7B depicts example data from a functional nuclease complex screening or selection experiment.

FIG. 11 discloses SEQ ID NOS 186-188, 187, 187, 187, 187, 187, 189, 186, 187 and 187, respectively, in order of appearance.

FIG. 17B discloses SEQ ID NOS 203 and 204, respectively, in order of appearance.

DETAILED DESCRIPTION OF THE DISCLOSURE

Figure 2:
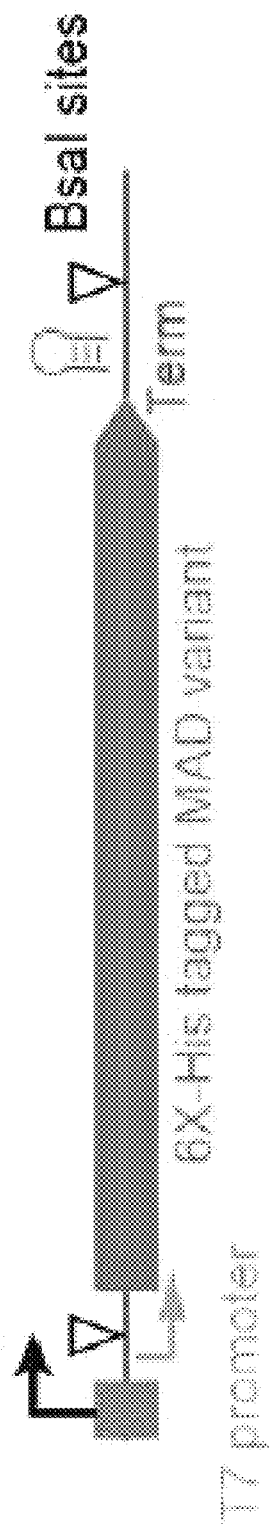
FIG. 2 depicts an example protein expression construct.

The present disclosure provides nucleic acid-guided nucleases and methods of use. Often, the subject nucleic-acid guided nucleases are part of a targetable nuclease system comprising a nucleic acid-guided nuclease and a guide nucleic acid. A subject targetable nuclease system can be used to cleave, modify, and/or edit a target polynucleotide sequence, often referred to as a target sequence. A subject targetable nuclease system refers collectively to transcripts and other elements involved in the expression of or directing the activity of genes, which may include sequences encoding a subject nucleic acid-guided nuclease protein and a guide nucleic acid as disclosed herein.

Methods, systems, vectors, polynucleotides, and compositions described herein may be used in various applications including altering or modifying synthesis of a gene product, such as a protein, polynucleotide cleavage, polynucleotide editing, polynucleotide splicing; trafficking of target polynucleotide, tracing of target polynucleotide, isolation of target polynucleotide, visualization of target polynucleotide, etc. Aspects of the invention also encompass methods and uses of the compositions and systems described herein in genome engineering, e.g. for altering or manipulating the expression of one or more genes or the one or more gene products, in prokaryotic, archaeal, or eukaryotic cells, in vitro, in vivo or ex vivo.

Nucleic Acid-Guided Nucleases

Bacterial and archaeal targetable nuclease systems have emerged as powerful tools for precision genome editing. However, naturally occurring nucleases have some limitations including expression and delivery challenges due to the nucleic acid sequence and protein size. Targetable nucleases that require PAM recognition are also limited in the sequences they can target throughout a genetic sequence. Other challenges include processivity, target recognition specificity and efficiency, and nuclease acidity efficiency, which often effect genetic editing efficiency.

Non-naturally occurring targetable nucleases and non-naturally occurring targetable nuclease systems can address many of these challenges and limitations.

Disclosed herein are non-naturally targetable nuclease systems. Such targetable nuclease systems are engineered to address one or more of the challenges described above and can be referred to as engineered nuclease systems. Engineered nuclease systems can comprise one or more of an engineered nuclease, such as an engineered nucleic acid-guided nuclease, an engineered guide nucleic acid, an engineered polynucleotides encoding said nuclease, or an engineered polynucleotides encoding said guide nucleic acid. Engineered nucleases, engineered guide nucleic acids, and engineered polynucleotides encoding the engineered nuclease or engineered guide nucleic acid are not naturally occurring and are not found in nature. It follows that engineered nuclease systems including one or more of these elements are non-naturally occurring.

Non-limiting examples of types of engineering that can be done to obtain a non-naturally occurring nuclease system are as follows. Engineering can include codon optimization to facilitate expression or improve expression in a host cell, such as a heterologous host cell. Engineering can reduce the size or molecular weight of the nuclease in order to facilitate expression or delivery. Engineering can alter PAM selection in order to change PAM specificity or to broaden the range of recognized PAMs. Engineering can alter, increase, or decrease stability, processivity, specificity, or efficiency of a targetable nuclease system. Engineering can alter, increase, or decrease protein stability. Engineering can alter, increase, or decrease processivity of nucleic acid scanning. Engineering can alter, increase, or decrease target sequence specificity. Engineering can alter, increase, or decrease nuclease activity. Engineering can alter, increase, or decrease editing efficiency. Engineering can alter, increase, or decrease transformation efficiency. Engineering can alter, increase, or decrease nuclease or guide nucleic acid expression.

Examples of non-naturally occurring nucleic acid sequences which are disclosed herein include sequences codon optimized for expression in bacteria, such as *E. coli* (e.g., SEQ ID NO: 41-60), sequences codon optimized for expression in single cell eukaryotes, such as yeast (e.g., SEQ ID NO: 127-146), sequences codon optimized for expression in multi cell eukaryotes, such as human cells (e.g., SEQ ID NO: 147-166), polynucleotides used for cloning or expression of any sequences disclosed herein (e.g., SEQ ID NO: 61-80), plasmids comprising nucleic acid sequences (e.g., SEQ ID NO: 21-40) operably linked to a heterologous promoter or nuclear localization signal or other heterologous element, proteins generated from engineered or codon optimized nucleic acid sequences (e.g., SEQ ID NO: 1-20), or engineered guide nucleic acids comprising any one of SEQ ID NO: 84-107. Such non-naturally occurring nucleic acid sequences can be amplified, cloned, assembled, synthesized, generated from synthesized oligonucleotides or dNTPs, or otherwise obtained using methods known by those skilled in the art.

Disclosed herein are nucleic acid-guided nucleases. Subject nucleases are functional in vitro, or in prokaryotic, archaeal, or eukaryotic cells for in vitro, in vivo, or ex vivo applications. Suitable nucleic acid-guided nucleases can be from an organism from a genus which includes but is not limited to *Thiomicrospira, Succinivibrio, Candidatus, Porphyromonas, Acidaminococcus, Acidomonococcus, Prevotella, Smithella, Moraxella, Synergistes, Francisella, Leptospira, Catenibacterium, Kandleria, Clostridium, Dorea, Coprococcus, Enterococcus, Fructobacillus, Weissella,*

*Pediococcus, Corynebacter, Sutterella, Legionella, Treponema, Roseburia, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma, Alicyclobacillus, Brevibacilus, Bacillus, Bacteroidetes, Brevibacilus, Carnobacterium, Clostridiaridium, Clostridium, Desulfonatronum, Desulfovibrio, Helcococcus, Leptotrichia, Listeria, Methanomethyophilus, Methylobacterium, Opitutaceae, Paludibacter, Rhodobacter, Sphaerochaeta, Tuberibacillus, Oleiphilus, Omnitrophica, Parcubacteria,* and *Campylobacter*. Species of organism of such a genus can be as otherwise herein discussed. Suitable nucleic acid-guided nucleases can be from an organism from a genus or unclassified genus within a kingdom which includes but is not limited to Firmicute, Actinobacteria, Bacteroidetes, Proteobacteria, Spirochates, and Tenericutes. Suitable nucleic acid-guided nucleases can be from an organism from a genus or unclassified genus within a phylum which includes but is not limited to Erysipelotrichia, Clostridia, Bacilli, Actinobacteria, Bacteroidetes, Flavobacteria, Alphaproteobacteria, Betaproteobacteria, Gammaproteobacteria, Deltaproteobacteria, Epsilonproteobacteria, Spirochaetes, and Mollicutes. Suitable nucleic acid-guided nucleases can be from an organism from a genus or unclassified genus within an order which includes but is not limited to Clostridiales, Lactobacillales, Actinomycetales, Bacteroidales, Flavobacteriales, Rhizobiales, Rhodospirillales, Burkholderiales, Neisseriales, Legionellales, Nautiliales, Campylobacterales, Spirochaetales, Mycoplasmatales, and Thiotrichales. Suitable nucleic acid-guided nucleases can be from an organism from a genus or unclassified genus within a family which includes but is not limited to Lachnospiraceae, Enterococcaceae, Leuconostocaceae, Lactobacillaceae, Streptococcaceae, Peptostreptococcaceae, Staphylococcaceae, Eubacteriaceae, Corynebacterineae, Bacteroidaceae, *Flavobacterium*, Cryomoorphaceae, Rhodobiaceae, Rhodospirillaceae, Acetobacteraceae, Sutterellaceae, Neisseriaceae, Legionellaceae, Nautiliaceae, Campylobacteraceae, Spirochaetaceae, Mycoplasmataceae, Pisciririckettsiaceae, and Francisellaceae. Other nucleic acid-guided nucleases have been describe in US Patent Application Publication No. US20160208243 filed Dec. 18, 2015, US Application Publication No. US20140068797 filed Mar. 15, 2013, U.S. Pat. No. 8,697, 359 filed Oct. 15, 2013, and Zetsche et al., Cell 2015 Oct. 22; 163(3):759-71, each of which are incorporated herein by reference in their entirety.

Some nucleic acid-guided nucleases suitable for use in the methods, systems, and compositions of the present disclosure include those derived from an organism such as, but not limited to, *Thiomicrospira* sp. XS5, *Eubacterium rectale, Succinivibrio dextrinosolvens, Candidatus Methanoplasma termitum, Candidatus Methanomethylophilus alvus, Porphyromonas crevioricanis, Flavobacterium branchiophilum, Acidaminococcus* Sp., *Acidomonococcus* sp., Lachnospiraceae bacterium COE1, *Prevotella brevis* ATCC 19188, *Smithella* sp. SCADC, *Moraxella bovoculi, Synergistes jonesii*, Bacteroidetes oral taxon 274, *Francisella tularensis, Leptospira inadai* serovar Lyme str. 10, *Acidomonococcus* sp. crystal structure (5B43) *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis*, Lachnospiraceae bacterium MC2017 1, *Butyrivibrio proteoclasticus, Butyrivibrio proteoclasticus* B316, Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, Candidatus *Methanoplasma termitum, Eubacterium eligens, Moraxella bovoculi* 237, *Leptospira inadai*, Lachnospiraceae bacterium ND2006, *Porphyromonas crevioricanis* 3, *Prevotella disiens, Porphyromonas macacae, Catenibacterium* sp. CAG:290, *Kandleria vitulina*, Clostridiales bacterium KA00274, Lachnospiraceae bacterium 3-2, *Dorea longicatena, Coprococcus catus* GD/7, *Enterococcus columbae* DSM 7374, *Fructobacillus* sp. EFB-N1, *Weissella halotolerans, Pediococcus acidilactici, Lactobacillus curvatus, Streptococcus pyogenes, Lactobacillus versmoldensis, Filifactor alocis* ATCC 35896, *Alicyclobacillus acidoterrestris, Alicyclobacillus acidoterrestris* ATCC 49025, *Desulfovibrio inopinatus, Desulfovibrio inopinatus* DSM 10711, *Oleiphilus* sp. *Oleiphilus* sp. HI0009, *Candidtus kefeldibacteria*, Parcubacteria CasY.4, Omnitrophica WOR 2 bacterium GWF2, *Bacillus* sp. NSP2.1, and *Bacillus thermoamylovorans*.

In some instances, a nucleic acid-guided nuclease disclosed herein comprises an amino acid sequence comprising at least 50% amino acid identity to any one of SEQ ID NO: 1-20. In some instances, a nuclease comprises an amino acid sequence comprising at least about 10%, 20%, 30%, 40%, 50%, 60%, 65%, 70%, 75%, 80%, 85%, 90%, 95%, greater than 95%, or 100% amino acid identity to any one of SEQ ID NO: 1-20. In some cases, the nucleic acid-guided nuclease comprises at least about 50%, 60%, 65%, 70%, 75%, 80%, 85%, 90%, 95%, greater than 95%, amino acid identity to any one of SEQ ID NO: 1-20. In some cases, the nucleic acid-guided nuclease comprises at least about 50%, 60%, 65%, 70%, 75%, 80%, 85%, 90%, 95%, greater than 95%, amino acid identity to any one of SEQ ID NO: 1-8 or 10-12. In some cases, the nucleic acid-guided nuclease comprises at least about 50%, 60%, 65%, 70%, 75%, 80%, 85%, 90%, 95%, greater than 95%, amino acid identity to any one of SEQ ID NO: 1-8 or 10-11. In some cases, the nucleic acid-guided nuclease comprises at least about 50%, 60%, 65%, 70%, 75%, 80%, 85%, 90%, 95%, greater than 95%, amino acid identity to SEQ ID NO: 2. In some cases, the nucleic acid-guided nuclease comprises at least about 50%, 60%, 65%, 70%, 75%, 80%, 85%, 90%, 95%, greater than 95%, amino acid identity to SEQ ID NO: 7.

In some cases, the nucleic acid-guided nuclease comprises any one of SEQ ID NO: 1-20. In some cases, the nucleic acid-guided nuclease comprises any one of SEQ ID NO: 1-8 or 10-12. In some cases, the nucleic acid-guided nuclease comprises any one of SEQ ID NO: 1-8 or 10-11. In some cases, the nucleic acid-guided nuclease comprises SEQ ID NO: 2. In some cases, the nucleic acid-guided nuclease comprises SEQ ID NO: 7.

In some instances, a nucleic acid-guided nuclease comprises an amino acid sequence comprising at most 10%, 15%, 20%, 25%, 30%, 35%, 40%, 45%, 50%, 55%, 60%, 65%, 70%, 75%, 80%, 85%, 90%, or 95% amino acid identity to any one of SEQ ID NO: 12 or SEQ ID NO: 108-110. In some instances, a nucleic acid-guided nuclease comprises an amino acid sequence comprising at most 50% amino acid identity to any one of SEQ ID NO: 12 or SEQ ID NO: 108-110. In some instances, a nucleic acid-guided nuclease comprises an amino acid sequence comprising at most 45% amino acid identity to any one of SEQ ID NO: 12 or SEQ ID NO: 108-110. In some instances, a nucleic acid-guided nuclease comprises an amino acid sequence comprising at most 40% amino acid identity to any one of SEQ ID NO: 12 or SEQ ID NO: 108-110. In some instances, a nucleic acid-guided nuclease comprises an amino acid sequence comprising at most 35% amino acid identity to any one of SEQ ID NO: 12 or SEQ ID NO: 108-110. In some instances, a nucleic acid-guided nuclease comprises an amino acid sequence comprising at most 30% amino acid identity to any one of SEQ ID NO: 12 or SEQ ID NO: 108-110.

In some instances, a nucleic acid-guided nuclease disclosed herein is encoded by a nucleic acid sequence comprising at least 50% sequence identity to any one of SEQ ID NO: 21-40. In some instances, a nuclease is encoded by a nucleic acid sequence comprising at least about 10%, 20%, 30%, 40%, 50%, 60%, 65%, 70%, 75%, 80%, 85%, 90%, 95%, greater than 95%, or 100% sequence identity to any one of SEQ ID NO: 21-40. In some instances, a nuclease is encoded by a nucleic acid sequence comprising at least about 50%, 60%, 65%, 70%, 75%, 80%, 85%, 90%, 95%, greater than 95%, sequence identity to any one of SEQ ID NO: 21-40. In some cases, the nucleic acid-guided nuclease is encoded by the nucleic acid sequence comprising at least about 50%, 60%, 65%, 70%, 75%, 80%, 85%, 90%, 95%, greater than 95%, sequence identity to any one of SEQ ID NO: 21-40. In some cases, the nucleic acid-guided nuclease is encoded by the nucleic acid sequence comprising at least about 50%, 60%, 65%, 70%, 75%, 80%, 85%, 90%, 95%, greater than 95%, sequence identity to any one of SEQ ID NO: 21-28 or 30-32. In some cases, the nucleic acid-guided nuclease is encoded by the nucleic acid sequence comprising at least about 50%, 60%, 65%, 70%, 75%, 80%, 85%, 90%, 95%, greater than 95%, sequence identity to any one of SEQ ID NO: 21-28 or 30-31. In some cases, the nucleic acid-guided nuclease is encoded by the nucleic acid sequence comprising at least about 50%, 60%, 65%, 70%, 75%, 80%, 85%, 90%, 95%, greater than 95%, sequence identity to SEQ ID NO: 22. In some cases, the nucleic acid-guided nuclease is encoded by the nucleic acid sequence comprising at least about 50%, 60%, 65%, 70%, 75%, 80%, 85%, 90%, 95%, greater than 95%, sequence identity to SEQ ID NO: 27.

In some cases, the nucleic acid-guided nuclease is encoded by the nucleic acid sequence of any one of SEQ ID NO: 21-40. In some cases, the nucleic acid-guided nuclease is encoded by the nucleic acid sequence of any one of SEQ ID NO: 21-28 or 30-32. In some cases, the nucleic acid-guided nuclease is encoded by the nucleic acid sequence of any one of SEQ ID NO: 21-28 or 30-31. In some cases, the nucleic acid-guided nuclease is encoded by the nucleic acid sequence of SEQ ID NO: 22. In some cases, the nucleic acid-guided nuclease is encoded by the nucleic acid sequence of SEQ ID NO: 27.

In some instances, a nucleic acid-guided nuclease disclosed herein is encoded on a nucleic acid sequence. Such a nucleic acid can be codon optimized for expression in a desired host cell. Suitable host cells can include, as non-limiting examples, prokaryotic cells such as *E. coli, P. aeruginosa, B. subtilus*, and *V. natriegens*, and eukaryotic cells such as *S. cerevisiae*, plant cells, insect cells, nematode cells, amphibian cells, fish cells, or mammalian cells, including human cells.

A nucleic acid sequence encoding a nucleic acid-guided nuclease can be codon optimized for expression in gram positive bacteria, e.g., *Bacillus subtilis*, or gram negative bacteria, e.g., *E. coli*. In some instances, a nucleic acid-guided nuclease disclosed herein is encoded by a nucleic acid sequence comprising at least 50% sequence identity to any one of SEQ ID NO: 41-60. In some instances, a nuclease is encoded by a nucleic acid sequence comprising at least about 10%, 20%, 30%, 40%, 50%, 60%, 65%, 70%, 75%, 80%, 85%, 90%, 95%, greater than 95%, or 100% sequence identity to any one of SEQ ID NO: 41-60. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 41-60. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 41-48 or 50-52. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 41-48 or 50-51. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 42. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 47.

In some cases, the nucleic acid-guided nuclease is encoded by the nucleic acid sequence of any one of SEQ ID NO: 41-60. In some cases, the nucleic acid-guided nuclease is encoded by the nucleic acid sequence of any one of SEQ ID NO: 41-48 or 50-52. In some cases, the nucleic acid-guided nuclease is encoded by the nucleic acid sequence of any one of SEQ ID NO: 41-48 or 50-51. In some cases, the nucleic acid-guided nuclease is encoded by the nucleic acid sequence of SEQ ID NO: 42. In some cases, the nucleic acid-guided nuclease is encoded by the nucleic acid sequence of SEQ ID NO: 47.

A nucleic acid sequence encoding a nucleic acid-guided nuclease can be codon optimized for expression in a species of yeast, e.g., *S. cerevisiae*. In some instances, a nucleic acid-guided nuclease disclosed herein is encoded by a nucleic acid sequence comprising at least 50% sequence identity to any one of SEQ ID NO: 127-146. In some instances, a nuclease is encoded by a nucleic acid sequence comprising at least about 10%, 20%, 30%, 40%, 50%, 60%, 65%, 70%, 75%, 80%, 85%, 90%, 95%, greater than 95%, or 100% sequence identity to any one of SEQ ID NO: 127-146. In some instances, a nuclease is encoded by a nucleic acid sequence comprising at least about 50%, 60%, 65%, 70%, 75%, 80%, 85%, 90%, 95%, greater than 95% sequence identity to any one of SEQ ID NO: 127-146. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 127-146. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 127-134 or 136-138. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 127-134 or 136-137. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 128. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 133.

In some cases, the nucleic acid-guided nuclease is encoded by the nucleic acid sequence of any one of SEQ ID NO: 127-146. In some cases, the nucleic acid-guided nuclease is encoded by the nucleic acid sequence of any one of SEQ ID NO: 127-134 or 136-138. In some cases, the nucleic acid-guided nuclease is encoded by the nucleic acid sequence of any one of SEQ ID NO: 127-134 or 136-137. In some cases, the nucleic acid-guided nuclease is encoded by the nucleic acid sequence of SEQ ID NO: 128. In some cases, the nucleic acid-guided nuclease is encoded by the nucleic acid sequence of SEQ ID NO: 133.

A nucleic acid sequence encoding a nucleic acid-guided nuclease can be codon optimized for expression in mammalian cells. In some instances, a nucleic acid-guided nuclease disclosed herein is encoded by a nucleic acid sequence comprising at least 50% sequence identity to any one of SEQ ID NO: 147-166. In some instances, a nuclease is encoded by a nucleic acid sequence comprising at least about 10%, 20%, 30%, 40%, 50%, 60%, 65%, 70%, 75%, 80%, 85%, 90%, 95%, greater than 95%, or 100% sequence identity to any one of SEQ ID NO: 147-166. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 147-166. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 147-154 or 156-158. In some cases, the nucleic acid-guided nuclease is encoded by the nucleic acid sequence comprising at least about 50%, 60%, 65%, 70%, 75%, 80%, 85%, 90%, 95%, greater than 95% sequence identity to any one of SEQ ID NO: 147-154 or 156-157. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 148. In some cases, the nucleic acid-guided nuclease is encoded by the nucleic acid sequence comprising at least about 50%, 60%, 65%, 70%, 75%, 80%, 85%, 90%, 95%, greater than 95% sequence identity to SEQ ID NO: 153.

In some cases, the nucleic acid-guided nuclease is encoded by the nucleic acid sequence of any one of SEQ ID NO: 147-166. In some cases, the nucleic acid-guided nuclease is encoded by the nucleic acid sequence of any one of SEQ ID NO: 147-154 or 156-158. In some cases, the nucleic acid-guided nuclease is encoded by the nucleic acid sequence of any one of SEQ ID NO: 147-154 or 156-157. In some cases, the nucleic acid-guided nuclease is encoded by the nucleic acid sequence of SEQ ID NO: 148. In some cases, the nucleic acid-guided nuclease is encoded by the nucleic acid sequence of SEQ ID NO: 153.

A nucleic acid sequence encoding a nucleic acid-guided nuclease can be operably linked to a promoter. Such nucleic acid sequences can be linear or circular. The nucleic acid sequences can be comprised on a larger linear or circular nucleic acid sequences that comprises additional elements such as an origin of replication, selectable or screenable marker, terminator, other components of a targetable nuclease system, such as a guide nucleic acid, or an editing or recorder cassette as disclosed herein. These larger nucleic acid sequences can be recombinant expression vectors, as are described in more detail later.

Guide Nucleic Acid

In general, a guide nucleic acid can complex with a compatible nucleic acid-guided nuclease and can hybridize with a target sequence, thereby directing the nuclease to the target sequence. A subject nucleic acid-guided nuclease capable of complexing with a guide nucleic acid can be referred to as a nucleic acid-guided nuclease that is compatible with the guide nucleic acid. Likewise, a guide nucleic acid capable of complexing with a nucleic acid-guided nuclease can be referred to as a guide nucleic acid that is compatible with the nucleic acid-guided nucleases.

A guide nucleic acid can be DNA. A guide nucleic acid can be RNA. A guide nucleic acid can comprise both DNA and RNA. A guide nucleic acid can comprise modified of non-naturally occurring nucleotides. In cases where the guide nucleic acid comprises RNA, the RNA guide nucleic acid can be encoded by a DNA sequence on a polynucleotide molecule such as a plasmid, linear construct, or editing cassette as disclosed herein.

A guide nucleic acid can comprise a guide sequence. A guide sequence is a polynucleotide sequence having sufficient complementarity with a target polynucleotide sequence to hybridize with the target sequence and direct sequence-specific binding of a complexed nucleic acid-guided nuclease to the target sequence. The degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences. In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20 nucleotides in length. Preferably the guide sequence is 10-30 nucleotides long. The guide sequence can be 15-20 nucleotides in length. The guide sequence can be 15 nucleotides in length. The guide sequence can be 16 nucleotides in length. The guide sequence can be 17 nucleotides in length. The guide sequence can be 18 nucleotides in length. The guide sequence can be 19 nucleotides in length. The guide sequence can be 20 nucleotides in length.

A guide nucleic acid can comprise a scaffold sequence. In general, a "scaffold sequence" includes any sequence that has sufficient sequence to promote formation of a targetable nuclease complex, wherein the targetable nuclease complex comprises a nucleic acid-guided nuclease and a guide nucleic acid comprising a scaffold sequence and a guide sequence. Sufficient sequence within the scaffold sequence to promote formation of a targetable nuclease complex may include a degree of complementarity along the length of two sequence regions within the scaffold sequence, such as one or two sequence regions involved in forming a secondary structure. In some cases, the one or two sequence regions are comprised or encoded on the same polynucleotide. In some cases, the one or two sequence regions are comprised or encoded on separate polynucleotides. Optimal alignment may be determined by any suitable alignment algorithm, and may further account for secondary structures, such as self-complementarity within either the one or two sequence regions. In some embodiments, the degree of complementarity between the one or two sequence regions along the length of the shorter of the two when optimally aligned is about or more than about 25%, 30%, 40%, 50%, 60%, 70%, 80%, 90%, 95%, 97.5%, 99%, or higher. In some embodiments, at least one of the two sequence regions is about or more than about 5, 6, 7, 8, 9, 10, 11, 12, 13, 14, 15, 16, 17, 18, 19, 20, 25, 30, 40, 50, or more nucleotides in length.

A scaffold sequence of a subject guide nucleic acid can comprise a secondary structure. A secondary structure can comprise a pseudoknot region. In some cases, binding kinetics of a guide nucleic acid to a nucleic acid-guided nuclease is determined in part by secondary structures within the scaffold sequence. In some cases, binding kinetics of a guide nucleic acid to a nucleic acid-guided nuclease is determined in part by nucleic acid sequence with the scaffold sequence.

A scaffold sequence can comprise the sequence of any one of SEQ ID NO: 84-107. A scaffold sequence can comprise the sequence of any one of SEQ ID NO: 84-103. A scaffold sequence can comprise the sequence of any one of SEQ ID NO: 84-91 or 93-95. A scaffold sequence can comprise the sequence of any one of SEQ ID NO: 88, 93, 94, or 95. A scaffold sequence can comprise the sequence of SEQ ID NO: 88. A scaffold sequence can comprise the sequence of SEQ ID NO: 93. A scaffold sequence can comprise the sequence of SEQ ID NO: 94. A scaffold sequence can comprise the sequence of SEQ ID NO: 95.

Figure 13A:
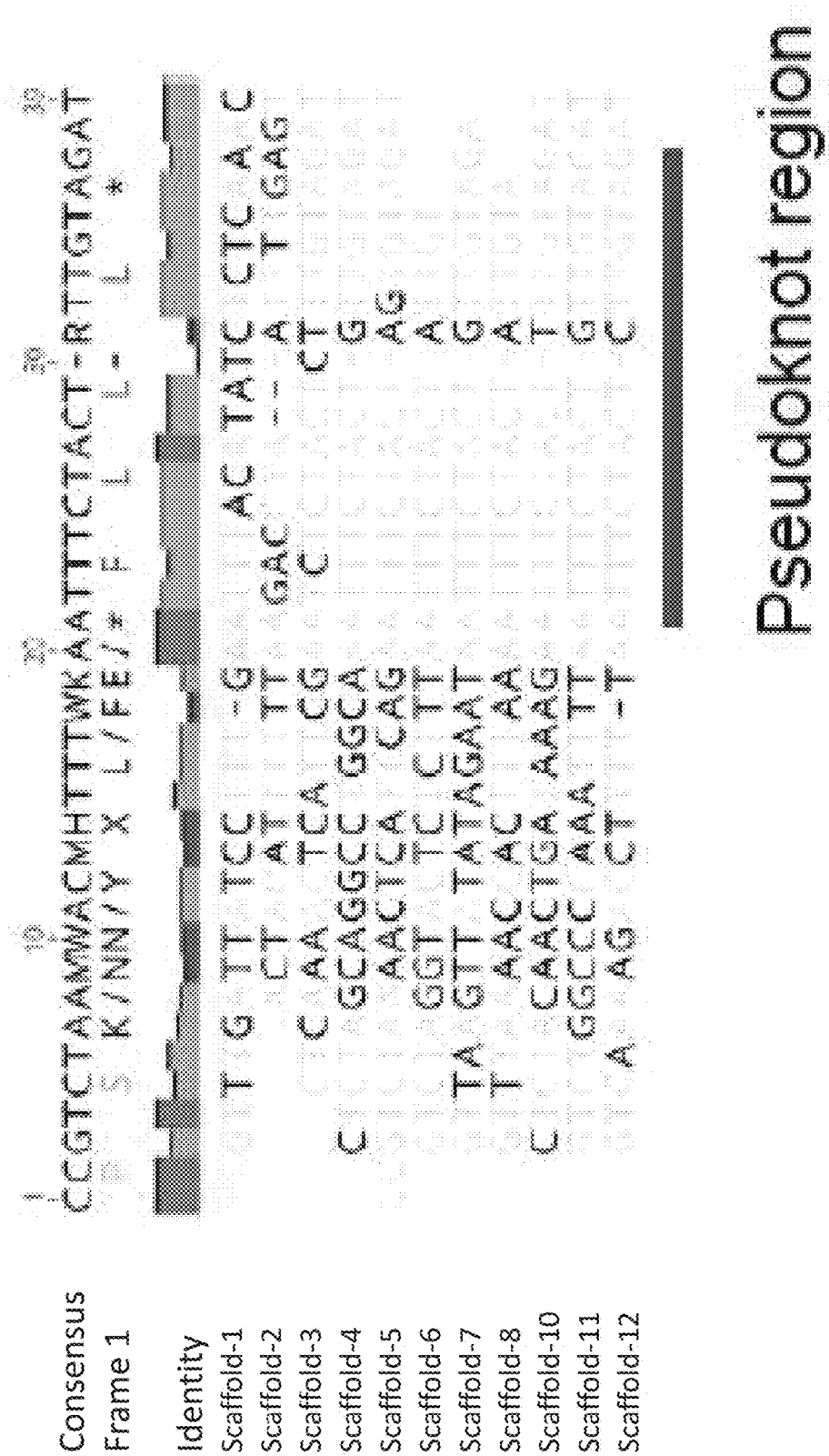
FIG. 13A depicts an example alignment of scaffold sequences (SEQ ID NOS 190-202, respectively, in order of appearance).

In some aspects, the invention provides a nuclease that binds to a guide nucleic acid comprising a conserved scaffold sequence. For example, the nucleic acid-guided nucleases for use in the present disclosure can bind to a conserved pseudoknot region as shown in FIG. 13A. Specifically, the nucleic acid-guided nucleases for use in the present disclosure can bind to a guide nucleic acid comprising a conserved pseudoknot region as shown in FIG. 13A. Certain nucleic acid-guided nucleases for use in the present disclosure can bind to a pseudoknot region having at least 75%, 80%, 85%, 90%, 95%, or 100% sequence identity to the pseudoknot region of Scaffold-1 (SEQ ID NO: 172). Other nucleic acid-guided nucleases for use in the present disclosure can bind to a pseudoknot region having at least 75%, 80%, 85%, 90%, 95%, or 100% sequence identity to the pseudoknot region of Scaffold-3 (SEQ ID NO: 173). Still other nucleic acid-guided nucleases for use in the present disclosure can bind to a pseudoknot region having at least 75%, 80%, 85%, 90%, 95%, or 100% sequence identity to the pseudoknot region of Scaffold-4 (SEQ ID NO: 174). Other nucleic acid-guided nucleases for use in the present disclosure can bind to a pseudoknot region having at least 75%, 80%, 85%, 90%, 95%, or 100% sequence identity to the pseudoknot region of Scaffold-5 (SEQ ID NO: 175). Other nucleic acid-guided nucleases for use in the present disclosure can bind to a pseudoknot region having at least 75%, 80%, 85%, 90%, 95%, or 100% sequence identity to the pseudoknot region of Scaffold-6 (SEQ ID NO: 176). Still other nucleic acid-guided nucleases for use in the present disclosure can bind to a pseudoknot region having at least 75%, 80%, 85%, 90%, 95%, or 100% sequence identity to the pseudoknot region of Scaffold-7 (SEQ ID NO: 177). Other nucleic acid-guided nucleases for use in the present disclosure can bind to a pseudoknot region having at least 75%, 80%, 85%, 90%, 95%, or 100% sequence identity to the pseudoknot region of Scaffold-8 (SEQ ID NO: 178). Other nucleic acid-guided nucleases for use in the present disclosure can bind to a pseudoknot region having at least 75%, 80%, 85%, 90%, 95%, or 100% sequence identity to the pseudoknot region of Scaffold-10 (SEQ ID NO: 179). Still other nucleic acid-guided nucleases for use in the present disclosure can bind to a pseudoknot region having at least 75%, 80%, 85%, 90%, 95%, or 100% sequence identity to the pseudoknot region of Scaffold-11 (SEQ ID NO: 180). Certain nucleic acid-guided nucleases for use in the present disclosure can bind to a pseudoknot region having at least 75%, 80%, 85%, 90%, 95%, or 100% sequence identity to the pseudoknot region of Scaffold-12 (SEQ ID NO: 181).

A guide nucleic acid can comprise the sequence of any one of SEQ ID NO: 84-107. A guide nucleic acid can comprise the sequence of any one of SEQ ID NO: 84-103. A guide nucleic acid can comprise the sequence of any one of SEQ ID NO: 84-91 or 93-95. A guide nucleic acid can comprise the sequence of any one of SEQ ID NO: 88, 93, 94, or 95. A guide nucleic acid can comprise the sequence of SEQ ID NO: 88. A guide nucleic acid can comprise the sequence of SEQ ID NO: 93. A guide nucleic acid can comprise the sequence of SEQ ID NO: 94. A guide nucleic acid can comprise the sequence of SEQ ID NO: 95.

In aspects of the invention the terms "guide nucleic acid" refers to one or more polynucleotides comprising 1) a guide sequence capable of hybridizing to a target sequence and 2) a scaffold sequence capable of interacting with or complexing with an nucleic acid-guided nuclease as described herein. A guide nucleic acid may be provided as one or more nucleic acids. In specific embodiments, the guide sequence and the scaffold sequence are provided as a single polynucleotide.

A guide nucleic acid can be compatible with a nucleic acid-guided nuclease when the two elements can form a functional targetable nuclease complex capable of cleaving a target sequence. Often, a compatible scaffold sequence for a compatible guide nucleic acid can be found by scanning sequences adjacent to a native nucleic acid-guided nuclease loci. In other words, native nucleic acid-guided nucleases can be encoded on a genome within proximity to a corresponding compatible guide nucleic acid or scaffold sequence.

Nucleic acid-guided nucleases can be compatible with guide nucleic acids that are not found within the nucleases endogenous host. Such orthogonal guide nucleic acids can be determined by empirical testing. Orthogonal guide nucleic acids can come from different bacterial species or be synthetic or otherwise engineered to be non-naturally occurring.

Orthogonal guide nucleic acids that are compatible with a common nucleic acid-guided nuclease can comprise one or more common features. Common features can include sequence outside a pseudoknot region. Common features can include a pseudoknot region. Common features can include a primary sequence or secondary structure.

A guide nucleic acid can be engineered to target a desired target sequence by altering the guide sequence such that the guide sequence is complementary to the target sequence, thereby allowing hybridization between the guide sequence and the target sequence. A guide nucleic acid with an engineered guide sequence can be referred to as an engineered guide nucleic acid. Engineered guide nucleic acids are often non-naturally occurring and are not found in nature.

Targetable Nuclease System

Disclosed herein are targetable nuclease systems. A targetable nuclease system can comprise a nucleic acid-guided nuclease and a compatible guide nucleic acid. A targetable nuclease system can comprise a nucleic acid-guided nuclease or a polynucleotide sequence encoding the nucleic acid-guided nuclease. A targetable nuclease system can comprise a guide nucleic acid or a polynucleotide sequence encoding the guide nucleic acid.

In general, a targetable nuclease system as disclosed herein is characterized by elements that promote the formation of a targetable nuclease complex at the site of a target sequence, wherein the targetable nuclease complex comprises a nucleic acid-guided nuclease and a guide nucleic acid.

A guide nucleic acid together with a nucleic acid-guided nuclease forms a targetable nuclease complex which is capable of binding to a target sequence within a target polynucleotide, as determined by the guide sequence of the guide nucleic acid.

In general, to generate a double stranded break, in most cases a targetable nuclease complex binds to a target sequence as determined by the guide nucleic acid, and the nuclease has to recognize a protospacer adjacent motif (PAM) sequence adjacent to the target sequence.

A targetable nuclease complex can comprise a nucleic acid-guided nuclease of any one of SEQ ID NO: 1-20 and a compatible guide nucleic acid. A targetable nuclease complex can comprise a nucleic acid-guided nuclease of any one of SEQ ID NO: 1-8 or 10-12 and a compatible guide nucleic acid. A targetable nuclease complex can comprise a nucleic acid-guided nuclease of any one of SEQ ID NO: 1-8 or 10-11 and a compatible guide nucleic acid. A targetable nuclease complex can comprise a nucleic acid-guided nuclease of SEQ ID NO: 2 and a compatible guide nucleic acid. A targetable nuclease complex can comprise a nucleic acid-guided nuclease of SEQ ID NO: 7 and a compatible guide nucleic acid. In any of these cases, the guide nucleic acid can comprise a scaffold sequence compatible with the nucleic acid-guided nuclease. In any of these cases, the guide nucleic acid can further comprise a guide sequence. The guide sequence can be engineered to target any desired target sequence. The guide sequence can be engineered to be complementary to any desired target sequence. The guide sequence can be engineered to hybridize to any desired target sequence.

A targetable nuclease complex can comprise a nucleic acid-guided nuclease of any one of SEQ ID NO: 1-20 and a compatible guide nucleic acid comprising any one of SEQ ID NO: 84-107. A targetable nuclease complex can comprise a nucleic acid-guided nuclease of any one of SEQ ID NO: 1-8 or 10-12 and a compatible guide nucleic acid comprising any one of SEQ ID NO: 84-95. A targetable nuclease complex can comprise a nucleic acid-guided nuclease of any one of SEQ ID NO: 1-8 or 10-11 and a compatible guide nucleic acid comprising any one of SEQ ID NO: 84-91 or 93-95. In any of these cases, the guide nucleic acid can further comprise a guide sequence. The guide sequence can be engineered to target any desired target sequence. The guide sequence can be engineered to be complementary to any desired target sequence. The guide sequence can be engineered to hybridize to any desired target sequence.

A targetable nuclease complex can comprise a nucleic acid-guided nuclease of SEQ ID NO: 2 and a compatible guide nucleic acid. A targetable nuclease complex can comprise a nucleic acid-guided nuclease of SEQ ID NO: 2 and a compatible guide nucleic acid comprising any one of SEQ ID NO: 88, 93, 94, or 95. A targetable nuclease complex can comprise a nucleic acid-guided nuclease of SEQ ID NO: 2 and a compatible guide nucleic acid comprising SEQ ID NO: 88. A targetable nuclease complex can comprise a nucleic acid-guided nuclease of SEQ ID NO: 2 and a compatible guide nucleic acid comprising SEQ ID NO: 93. A targetable nuclease complex can comprise a nucleic acid-guided nuclease of SEQ ID NO: 2 and a compatible guide nucleic acid comprising SEQ ID NO: 94. A targetable nuclease complex can comprise a nucleic acid-guided nuclease of SEQ ID NO: 2 and a compatible guide nucleic acid comprising SEQ ID NO: 95. In any of these cases, the guide nucleic acid can further comprise a guide sequence. The guide sequence can be engineered to target any desired target sequence. The guide sequence can be engineered to be complementary to any desired target sequence. The guide sequence can be engineered to hybridize to any desired target sequence.

A targetable nuclease complex can comprise a nucleic acid-guided nuclease of SEQ ID NO: 7 and a compatible guide nucleic acid. A targetable nuclease complex can comprise a nucleic acid-guided nuclease of SEQ ID NO: 7 and a compatible guide nucleic acid comprising any one of SEQ ID NO: 88, 93, 94, or 95. A targetable nuclease complex can comprise a nucleic acid-guided nuclease of SEQ ID NO: 7 and a compatible guide nucleic acid comprising SEQ ID NO: 88. A targetable nuclease complex can comprise a nucleic acid-guided nuclease of SEQ ID NO: 7 and a compatible guide nucleic acid comprising SEQ ID NO: 93. A targetable nuclease complex can comprise a nucleic acid-guided nuclease of SEQ ID NO: 7 and a compatible guide nucleic acid comprising SEQ ID NO: 94. A targetable nuclease complex can comprise a nucleic acid-guided nuclease of SEQ ID NO: 7 and a compatible guide nucleic acid comprising SEQ ID NO: 95. In any of these cases, the guide nucleic acid can further comprise a guide sequence. The guide sequence can be engineered to target any desired target sequence. The guide sequence can be engineered to be complementary to any desired target sequence. The guide sequence can be engineered to hybridize to any desired target sequence.

A target sequence of a targetable nuclease complex can be any polynucleotide endogenous or exogenous to a prokaryotic or eukaryotic cell, or in vitro. For example, the target sequence can be a polynucleotide residing in the nucleus of the eukaryotic cell. A target sequence can be a sequence coding a gene product (e.g., a protein) or a non-coding sequence (e.g., a regulatory polynucleotide or a junk DNA). Without wishing to be bound by theory, it is believed that the target sequence should be associated with a PAM; that is, a short sequence recognized by a targetable nuclease complex. The precise sequence and length requirements for a PAM differ depending on the nucleic acid-guided nuclease used, but PAMs are typically 2-5 base pair sequences adjacent the target sequence. Examples of PAM sequences are given in the examples section below, and the skilled person will be able to identify further PAM sequences for use with a given nucleic acid-guided nuclease. Further, engineering of the PAM Interacting (PI) domain may allow programming of PAM specificity, improve target site recognition fidelity, and increase the versatility of a nucleic acid-guided nuclease genome engineering platform. Nucleic acid-guided nucleases may be engineered to alter their PAM specificity, for example as described in Kleinstiver B P et al. Engineered CRISPR-Cas9 nucleases with altered PAM specificities. Nature. 2015 Jul. 23; 523 (7561): 481-5. doi: 10.1038/nature14592.

A PAM site is a nucleotide sequence in proximity to a target sequence. In most cases, a nucleic acid-guided nuclease can only cleave a target sequence if an appropriate PAM is present. PAMs are nucleic acid-guided nuclease-specific and can be different between two different nucleic acid-guided nucleases. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length.

In some examples, a PAM can be provided on a separate oligonucleotide. In such cases, providing PAM on a oligonucleotide allows cleavage of a target sequence that otherwise would not be able to be cleave because no adjacent PAM is present on the same polynucleotide as the target sequence.

Polynucleotide sequences encoding a component of a targetable nuclease system can comprise one or more vectors. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. Further discussion of vectors is provided herein.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

In some embodiments, a regulatory element is operably linked to one or more elements of a targetable nuclease system so as to drive expression of the one or more components of the targetable nuclease system.

In some embodiments, a vector comprises a regulatory element operably linked to a polynucleotide sequence encoding a nucleic acid-guided nuclease. The polynucleotide sequence encoding the nucleic acid-guided nuclease can be codon optimized for expression in particular cells, such as prokaryotic or eukaryotic cells. Eukaryotic cells can be yeast, fungi, algae, plant, animal, or human cells. Eukaryotic cells may be those of or derived from a particular organism, such as a mammal, including but not limited to human, mouse, rat, rabbit, dog, or non-human mammal including non-human primate.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ (visited Jul. 9, 2002), and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

In some embodiments, a vector encodes a nucleic acid-guided nuclease comprising one or more nuclear localization sequences (NLSs), such as about or more than about 1, 2, 3, 4, 5, 6, 7, 8, 9, 10, or more NLSs. In some embodiments, the engineered nuclease comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the engineered nuclease comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 111); the NLS from nucleoplasmin (e.g. the nucleoplasmin bipartite NLS with the sequence KRPAATKKAGQAKKKK (SEQ ID NO:112)); the c-myc NLS having the amino acid sequence PAAKRVKLD (SEQ ID NO:113) or RQRRNELKRSP (SEQ ID NO:114); the hRNPA1 M9 NLS having the sequence NQSSNFGPMKGGNFGGRSSGPYGGGGQYFAKPRNQGGY (SEQ ID NO: 115); the sequence RMRIZFKNKGKDTAELRRRRVEVSVELRKAKKDEQ-ILKRRNV (SEQ ID NO:1 116) of the IBB domain from importin-alpha; the sequences VSRKRPRP (SEQ ID NO:117) and PPKKARED (SEQ ID NO:118) of the myoma T protein; the sequence PQPKKKPL (SEQ ID NO:119) of human p53; the sequence SALIKKKKKMAP (SEQ ID NO:120) of mouse c-abl IV; the sequences DRLRR (SEQ ID NO:121) and PKQKKRK (SEQ ID NO:122) of the influenza virus NS1; the sequence RKLKKKIKKL (SEQ ID NO:123) of the Hepatitis virus delta antigen; the sequence REKK-KFLKRR (SEQ ID NO: 124) of the mouse Mx1 protein; the sequence KRKGDEVDGVDEVAKKKSKK (SEQ ID NO: 125) of the human poly(ADP-ribose) polymerase; and the sequence RKCLQAGMNLEARKTKK (SEQ ID NO: 126) of the steroid hormone receptors (human) glucocorticoid.

In general, the one or more NLSs are of sufficient strength to drive accumulation of the nucleic acid-guided nuclease in a detectable amount in the nucleus of a eukaryotic cell. In general, strength of nuclear localization activity may derive from the number of NLSs, the particular NLS(s) used, or a combination of these factors. Detection of accumulation in the nucleus may be performed by any suitable technique. For example, a detectable marker may be fused to the nucleic acid-guided nuclease, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of the nucleic acid-guided nuclease complex formation (e.g. assay for DNA cleavage or mutation at the target sequence, or assay for altered gene expression activity affected by targetable nuclease complex formation and/or nucleic acid-guided nuclease activity), as compared to a control not exposed to the nucleic acid-guided nuclease or targetable nuclease complex, or exposed to a nucleic acid-guided nuclease lacking the one or more NLSs.

A nucleic acid-guided nuclease and one or more guide nucleic acids can be delivered either as DNA or RNA. Delivery of an nucleic acid-guided nuclease and guide nucleic acid both as RNA (unmodified or containing base or backbone modifications) molecules can be used to reduce the amount of time that the nucleic acid-guided nuclease persist in the cell. This may reduce the level of off-target cleavage activity in the target cell. Since delivery of a nucleic acid-guided nuclease as mRNA takes time to be translated into protein, it might be advantageous to deliver the guide nucleic acid several hours following the delivery of the nucleic acid-guided nuclease mRNA, to maximize the level of guide nucleic acid available for interaction with the nucleic acid-guided nuclease protein. In other cases, the nucleic acid-guided nuclease mRNA and guide nucleic acid are delivered concomitantly. In other examples, the guide nucleic acid is delivered sequentially, such as 0.5, 1, 2, 3, 4, or more hours after the nucleic acid-guided nuclease mRNA.

In situations where guide nucleic acid amount is limiting, it may be desirable to introduce a nucleic acid-guided nuclease as mRNA and guide nucleic acid in the form of a DNA expression cassette with a promoter driving the expression of the guide nucleic acid. This way the amount of guide nucleic acid available will be amplified via transcription.

Guide nucleic acid in the form of RNA or encoded on a DNA expression cassette can be introduced into a host cell comprising an nucleic acid-guided nuclease encoded on a vector or chromosome. The guide nucleic acid may be provided in the cassette one or more polynucleotides, which may be contiguous or non-contiguous in the cassette. In specific embodiments, the guide nucleic acid is provided in the cassette as a single contiguous polynucleotide.

A variety of delivery systems can be used to introduce a nucleic acid-guided nuclease (DNA or RNA) and guide nucleic acid (DNA or RNA) into a host cell. These include the use of yeast systems, lipofection systems, microinjection systems, biolistic systems, virosomes, liposomes, immunoliposomes, polycations, lipid:nucleic acid conjugates, virions, artificial virions, viral vectors, electroporation, cell permeable peptides, nanoparticles, nanowires (Shalek et al., Nano Letters, 2012), exosomes. Molecular trojan horses liposomes (Pardridge et al., Cold Spring Harb Protoc; 2010; doi:10.1101/pdb.prot5407) may be used to deliver an engineered nuclease and guide nuclease across the blood brain barrier.

In some embodiments, a editing template is also provided. A editing template may be a component of a vector as described herein, contained in a separate vector, or provided as a separate polynucleotide, such as an oligonucleotide, linear polynucleotide, or synthetic polynucleotide. In some cases, a editing template is on the same polynucleotide as a guide nucleic acid. In some embodiments, a editing template is designed to serve as a template in homologous recombination, such as within or near a target sequence nicked or cleaved by a nucleic acid-guided nuclease as a part of a complex as disclosed herein. A editing template polynucleotide may be of any suitable length, such as about or more than about 10, 15, 20, 25, 50, 75, 100, 150, 200, 500, 1000, or more nucleotides in length. In some embodiments, the editing template polynucleotide is complementary to a portion of a polynucleotide comprising the target sequence. When optimally aligned, a editing template polynucleotide might overlap with one or more nucleotides of a target sequences (e.g. about or more than about 1, 5, 10, 15, 20, 25, 30, 35, 40, or more nucleotides). In some embodiments, when a editing template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

In many examples, an editing template comprises at least one mutation compared to the target sequence. An editing template can comprise an insertion, deletion, modification, or any combination thereof compared to the target sequence. Examples of some editing templates are described in more detail in a later section.

In some aspects, the invention provides methods comprising delivering one or more polynucleotides, such as or one or more vectors or linear polynucleotides as described herein, one or more transcripts thereof, and/or one or proteins transcribed therefrom, to a host cell. In some aspects, the invention further provides cells produced by such methods, and organisms comprising or produced from such cells. In some embodiments, an engineered nuclease in combination with (and optionally complexed with) a guide nucleic acid is delivered to a cell.

Conventional viral and non-viral based gene transfer methods can be used to introduce nucleic acids in cells, such as prokaryotic cells, eukaryotic cells, mammalian cells, or target tissues. Such methods can be used to administer nucleic acids encoding components of an engineered nucleic acid-guided nuclease system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Feigner, TIBTECH 11:211-217 (1993); Mitani & Caskey, TIBTECH 11:162-166 (1993); Dillon. TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bohm (eds) (1995); and Yu et al., Gene Therapy 1:13-26 (1994).

Methods of non-viral delivery of nucleic acids include lipofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system.

Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

In some embodiments, a host cell is transiently or non-transiently transfected with one or more vectors, linear polynucleotides, polypeptides, nucleic acid-protein complexes, or any combination thereof as described herein. In some embodiments, a cell in transfected in vitro, in culture, or ex vivo. In some embodiments, a cell is transfected as it naturally occurs in a subject. In some embodiments, a cell that is transfected is taken from a subject. In some embodiments, the cell is derived from cells taken from a subject, such as a cell line.

In some embodiments, a cell transfected with one or more vectors, linear polynucleotides, polypeptides, nucleic acid-protein complexes, or any combination thereof as described herein is used to establish a new cell line comprising one or more transfection-derived sequences. In some embodiments, a cell transiently transfected with the components of an engineered nucleic acid-guided nuclease system as described herein (such as by transient transfection of one or more vectors, or transfection with RNA), and modified through the activity of an engineered nuclease complex, is used to establish a new cell line comprising cells containing the modification but lacking any other exogenous sequence.

In some embodiments, one or more vectors described herein are used to produce a non-human transgenic cell, organism, animal, or plant. In some embodiments, the transgenic animal is a mammal, such as a mouse, rat, or rabbit. Methods for producing transgenic cells, organisms, plants, and animals are known in the art, and generally begin with a method of cell transformation or transfection, such as described herein.

Methods of Use

In the context of formation of an engineered nuclease complex, "target sequence" refers to a sequence to which a guide sequence is designed to have complementarity, where hybridization between a target sequence and a guide sequence promotes the formation of a engineered nuclease complex. A target sequence may comprise any polynucleotide, such as DNA, RNA, or a DNA-RNA hybrid. A target sequence can be located in the nucleus or cytoplasm of a cell. A target sequence can be located in vitro or in a cell-free environment.

Typically, formation of an engineered nuclease complex comprising a guide nucleic acid hybridized to a target sequence and complexed with one or more engineered nucleases as disclosed herein results in cleavage of one or both strands in or near (e.g. within 1, 2, 3, 4, 5, 6, 7, 8, 9, 10, 20, 50, or more base pairs from) the target sequence. Cleavage can occur within a target sequence, 5' of the target sequence, upstream of a target sequence, 3' of the target sequence, or downstream of a target sequence.

In some embodiments, one or more vectors driving expression of one or more components of a targetable nuclease system are introduced into a host cell or in vitro such formation of a targetable nuclease complex at one or more target sites. For example, a nucleic acid-guided nuclease and a guide nucleic acid could each be operably linked to separate regulatory elements on separate vectors. Alternatively, two or more of the elements expressed from the same or different regulatory elements, may be combined in a single vector, with one or more additional vectors providing any components of the targetable nuclease system not included in the first vector. Targetable nuclease system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-guided nuclease and one or more guide nucleic acids. In some embodiments, a nucleic acid-guided nuclease and one or more guide nucleic acids are operably linked to and expressed from the same promoter. In other embodiments, one or more guide nucleic acids or polynucleotides encoding the one or more guide nucleic acids are introduced into a cell or in vitro environment already comprising a nucleic acid-guided nuclease or polynucleotide sequence encoding the nucleic acid-guided nuclease.

When multiple different guide sequences are used, a single expression construct may be used to target nuclease activity to multiple different, corresponding target sequences within a cell or in vitro. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell or in vitro.

Methods and compositions disclosed herein may comprise more than one guide nucleic acid, wherein each guide nucleic acid has a different guide sequence, thereby targeting a different target sequence. In such cases, multiple guide nucleic acids can be using in multiplexing, wherein multiple targets are targeted simultaneously. Additionally or alternatively, the multiple guide nucleic acids are introduced into a population of cells, such that each cell in a population received a different or random guide nucleic acid, thereby targeting multiple different target sequences across a population of cells. In such cases, the collection of subsequently altered cells can be referred to as a library.

Methods and compositions disclosed herein may comprise multiple different nucleic acid-guided nucleases, each with one or more different corresponding guide nucleic acids, thereby allowing targeting of different target sequences by different nucleic acid-guided nucleases. In some such cases, each nucleic acid-guided nuclease can correspond to a distinct plurality of guide nucleic acids, allowing two or more non overlapping, partially overlapping, or completely overlapping multiplexing events.

In some embodiments, the nucleic acid-guided nuclease has DNA cleavage activity or RNA cleavage activity. In some embodiments, the nucleic acid-guided nuclease directs cleavage of one or both strands at the location of a target sequence, such as within the target sequence and/or within the complement of the target sequence. In some embodiments, the nucleic acid-guided nuclease directs cleavage of one or both strands within about 1, 2, 3, 4, 5, 6, 7, 8, 9, 10, 15, 20, 25, 50, 100, 200, 500, or more base pairs from the first or last nucleotide of a target sequence.

In some embodiments, a nucleic acid-guided nuclease may form a component of an inducible system. The inducible nature of the system would allow for spatiotemporal control of gene editing or gene expression using a form of energy. The form of energy may include but is not limited to electromagnetic radiation, sound energy, chemical energy, light energy, temperature, and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochorome). In one embodiment, the nucleic acid-guided nuclease may be a part of a Light Inducible Transcriptional Effector (LITE) to direct changes in transcriptional activity in a sequence-specific manner. The components of a light inducible system may include a nucleic acid-guided nuclease, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety. An inducible system can be temperature inducible such that the system is turned on or off by increasing or decreasing the temperature. In some temperature inducible systems, increasing the temperature turns the system on. In some temperature inducible systems, increasing the temperature turns the system off.

In some aspects, the invention provides for methods of modifying a target sequence in vitro, or in a prokaryotic or eukaryotic cell, which may be in vivo, ex vivo, or in vitro. In some embodiments, the method comprises sampling a cell or population of cells such as prokaryotic cells, or those from a human or non-human animal or plant (including micro-algae), and modifying the cell or cells. Culturing may occur at any stage in vitro or ex vivo. The cell or cells may even be re-introduced into the host, such as a non-human animal or plant (including micro-algae). For re-introduced cells it is particularly preferred that the cells are stem cells.

In some embodiments, the method comprises allowing a targetable nuclease complex to bind to the target sequence to effect cleavage of said target sequence, thereby modifying the target sequence, wherein the targetable nuclease complex comprises a nucleic acid-guided nuclease complexed with a guide nucleic acid wherein the guide sequence of the guide nucleic acid is hybridized to a target sequence within a target polynucleotide.

In some aspects, the invention provides a method of modifying expression of a target polynucleotide in in vitro or in a prokaryotic or eukaryotic cell. In some embodiments, the method comprises allowing an targetable nuclease complex to bind to a target sequence with the target polynucleotide such that said binding results in increased or decreased expression of said target polynucleotide; wherein the targetable nuclease complex comprises an nucleic acid-guided nuclease complexed with a guide nucleic acid, and wherein the guide sequence of the guide nucleic acid is hybridized to a target sequence within said target polynucleotide. Similar considerations apply as above for methods of modifying a target polynucleotide. In fact, these sampling, culturing and re-introduction options apply across the aspects of the present invention.

In some aspects, the invention provides kits containing any one or more of the elements disclosed in the above methods and compositions. Elements may provide individually or in combinations, and may be provided in any suitable container, such as a vial, a bottle, or a tube. In some embodiments, the kit includes instructions in one or more languages, for example in more than one language.

In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide sequence and a regulatory element. In some embodiments, the kit comprises a editing template.

In some aspects, the invention provides methods for using one or more elements of a engineered targetable nuclease system. A targetable nuclease complex of the disclosure provides an effective means for modifying a target sequence within a target polynucleotide. A targetable nuclease complex of the disclosure has a wide variety of utility including modifying (e.g., deleting, inserting, translocating, inactivating, activating) a target sequence in a multiplicity of cell types. As such a targetable nuclease complex of the invention has a broad spectrum of applications in, e.g., biochemical pathway optimization, genome-wide studies, genome engineering, gene therapy, drug screening, disease diagnosis, and prognosis. An exemplary targetable nuclease complex comprises a nucleic acid-guided nuclease as disclosed herein complexed with a guide nucleic acid, wherein the guide sequence of the guide nucleic acid can hybridize to a target sequence within the target polynucleotide. A guide nucleic acid can comprise a guide sequence linked to a scaffold sequence. A scaffold sequence can comprise one or more sequence regions with a degree of complementarity such that together they form a secondary structure. In some cases, the one or more sequence regions are comprised or encoded on the same polynucleotide. In some cases, the one or more sequence regions are comprised or encoded on separate polynucleotides.

Provided herein are methods of cleaving a target polynucleotide. The method comprises cleaving a target polynucleotide using a targetable nuclease complex that binds to a target sequence within a target polynucleotide and effect cleavage of said target polynucleotide. Typically, the targetable nuclease complex of the invention, when introduced into a cell, creates a break (e.g., a single or a double strand break) in the target sequence. For example, the method can be used to cleave a target gene in a cell, or to replace a wildtype sequence with a modified sequence.

The break created by the targetable nuclease complex can be repaired by a repair processes such as the error prone non-homologous end joining (NHEJ) pathway, the high fidelity homology-directed repair (HDR), or by recombination pathways. During these repair processes, a editing template can be introduced into the genome sequence. In some methods, the HDR or recombination process is used to modify a target sequence. For example, an editing template comprising a sequence to be integrated flanked by an upstream sequence and a downstream sequence is introduced into a cell. The upstream and downstream sequences share sequence similarity with either side of the site of integration in the chromosome, target vector, or target polynucleotide.

An editing template can be DNA or RNA, e.g., a DNA plasmid, a bacterial artificial chromosome (BAC), a yeast artificial chromosome (YAC), a viral vector, a linear piece of DNA, a PCR fragment, oligonucleotide, synthetic polynucleotide, a naked nucleic acid, or a nucleic acid complexed with a delivery vehicle such as a liposome or poloxamer.

An editing template polynucleotide can comprise a sequence to be integrated (e.g, a mutated gene). A sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function. Sequence to be integrated may be a mutated or variant of an endogenous wildtype sequence. Alternatively, sequence to be integrated may be a wildtype version of an endogenous mutated sequence. Additionally or alternatively, sequenced to be integrated may be a variant or mutated form of an endogenous mutated or variant sequence.

Upstream and downstream sequences in an editing template polynucleotide can be selected to promote recombination between the target polynucleotide of interest and the editing template polynucleotide. The upstream sequence can be a nucleic acid sequence having sequence similarity with the sequence upstream of the targeted site for integration. Similarly, the downstream sequence can be a nucleic acid sequence having similarity with the sequence downstream of the targeted site of integration. The upstream and downstream sequences in an editing template can have 75%, 80%, 85%, 90%, 95%, or 100% sequence identity with the targeted polynucleotide. Preferably, the upstream and downstream sequences in the editing template polynucleotide have about 95%, 96%, 97%, 98%, 99%, or 100% sequence identity with the targeted polynucleotide. In some methods, the upstream and downstream sequences in the editing template polynucleotide have about 99% or 100% sequence identity with the targeted polynucleotide.

An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence has about 15 bp to about 50 bp, about 30 bp to about 100 bp, about 200 bp to about 2000 bp, about 600 bp to about 1000 bp, or more particularly about 700 bp to about 1000 bp.

In some methods, the editing template polynucleotide may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Green and Sambrook et al., 2014 and Ausubel et al., 2017).

In an exemplary method for modifying a target polynucleotide by integrating an editing template polynucleotide, a double stranded break is introduced into the genome sequence by an engineered nuclease complex, the break can be repaired via homologous recombination using an editing template such that the template is integrated into the target polynucleotide. The presence of a double-stranded break can increase the efficiency of integration of the editing template.

Disclosed herein are methods for modifying expression of a polynucleotide in a cell. Some methods comprise increasing or decreasing expression of a target polynucleotide by using a targetable nuclease complex that binds to the target polynucleotide.

In some methods, a target polynucleotide can be inactivated to effect the modification of the expression in a cell. For example, upon the binding of a targetable nuclease complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced.

In some methods, a control sequence can be inactivated such that it no longer functions as a regulatory sequence. As used herein, "regulatory sequence" can refer to any nucleic acid sequence that effects the transcription, translation, or accessibility of a nucleic acid sequence. Examples of regulatory sequences include, a promoter, a transcription terminator, and an enhancer.

An inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knockout" of the target sequence.

An altered expression of one or more target polynucleotides associated with a signaling biochemical pathway can be determined by assaying for a difference in the mRNA levels of the corresponding genes between the test model cell and a control cell, when they are contacted with a candidate agent. Alternatively, the differential expression of the sequences associated with a signaling biochemical pathway is determined by detecting a difference in the level of the encoded polypeptide or gene product.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Green and Sambrook (2014), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorocoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan™ probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency, for instance as described herein. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Green and Sambrook, et al., (2014); Nonradioactive in Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, .beta.-galactosidase, urease, alkaline phosphatase or peroxidase, avidin/biotin complex.

Detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction can be performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer. Anti-phosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2.alpha.). Alternatively, these antibodies can be generated using conventional polyclonal or monoclonal antibody technologies by immunizing a host animal or an antibody-producing cell with a target protein that exhibits the desired post-translational modification.

In practicing a subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell, tissue, organism, or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

A target polynucleotide of a targetable nuclease complex can be any polynucleotide endogenous or exogenous to the host cell. For example, the target polynucleotide can be a polynucleotide residing in the nucleus of the eukaryotic cell, the genome of a prokaryotic cell, or an extrachromosomal vector of a host cell. The target polynucleotide can be a sequence coding a gene product (e.g., a protein) or a non-coding sequence (e.g., a regulatory polynucleotide or a junk DNA).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non-disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Embodiments of the invention also relate to methods and compositions related to knocking out genes, editing genes, altering genes, amplifying genes, and repairing particular mutations. Altering genes may also mean the epigenetic manipulation of a target sequence. This may be the chromatin state of a target sequence, such as by modification of the methylation state of the target sequence (i.e. addition or removal of methylation or methylation patterns or CpG islands), histone modification, increasing or reducing accessibility to the target sequence, or by promoting 3D folding. It will be appreciated that where reference is made to a method of modifying a cell, organism, or mammal including human or a non-human mammal or organism by manipulation of a target sequence in a genomic locus of interest, this may apply to the organism (or mammal) as a whole or just a single cell or population of cells from that organism (if the organism is multicellular). In the case of humans, for instance, Applicants envisage, inter alia, a single cell or a population of cells and these may preferably be modified ex vivo and then re-introduced. In this case, a biopsy or other tissue or biological fluid sample may be necessary. Stem cells are also particularly preferred in this regard. But, of course, in vivo embodiments are also envisaged. And the invention is especially advantageous as to HSCs.

The functionality of a targetable nuclease complex can be assessed by any suitable assay. For example, the components of a targetable nuclease system sufficient to form a targetable nuclease complex, including a guide nucleic acid and nucleic acid-guided nuclease, can be provided to a host cell having the corresponding target sequence, such as by transfection with vectors encoding the components of the engineered nuclease system, followed by an assessment of preferential cleavage within the target sequence. Similarly, cleavage of a target sequence may be evaluated in a test tube by providing the target sequence and components of a targetable nuclease complex. Other assays are possible, and will occur to those skilled in the art. A guide sequence can be selected to target any target sequence. In some embodiments, the target sequence is a sequence within a genome of a cell. Exemplary target sequences include those that are unique in the target genome.

Editing Cassette

Disclosed herein are compositions and methods for editing a target polynucleotide sequence. Such compositions include polynucleotides containing one or more components of targetable nuclease system. Polynucleotide sequences for use in these methods can be referred to as editing cassettes.

An editing cassette can comprise one or more primer sites. Primer sites can be used to amplify an editing cassette by using oligonucleotide primers comprising reverse complementary sequences that can hybridize to the one or more primer sites. An editing cassette can comprise two or more primer times. Sometimes, an editing cassette comprises a primer site on each end of the editing cassette, said primer sites flanking one or more of the other components of the editing cassette. Primer sites can be approximately 10, 15, 16, 17, 18, 19, 20, 21, 22, 23, 24, 25, 26 or more nucleotides in length.

An editing cassette can comprise an editing template as disclosed herein. An editing cassette can comprise an editing sequence. An editing sequence can be homologous to a target sequence. An editing sequence can comprise at least one mutation relative to a target sequence. An editing sequence often comprises homology region (or homology arms) flanking at least one mutation relative to a target sequence, such that the flanking homology regions facilitate homologous recombination of the editing sequence into a target sequence. An editing sequence can comprise an editing template as disclosed herein. For example, the editing sequence can comprise at least one mutation relative to a target sequence including one or more PAM mutations that mutate or delete a PAM site. An editing sequence can comprise one or more mutations in a codon or non-coding sequence relative to a non-editing target site.

A PAM mutation can be a silent mutation. A silent mutation can be a change to at least one nucleotide of a codon relative to the original codon that does not change the amino acid encoded by the original codon. A silent mutation can be a change to a nucleotide within a non-coding region, such as an intron, 5' untranslated region, 3' untranslated region, or other non-coding region.

A PAM mutation can be a non-silent mutation. Non-silent mutations can include a missense mutation. A missense mutation can be when a change to at least one nucleotide of a codon relative to the original codon that changes the amino acid encoded by the original codon. Missense mutations can occur within an exon, open reading frame, or other coding region.

An editing sequence can comprise at least one mutation relative to a target sequence. A mutation can be a silent mutation or non-silent mutation, such as a missense mutation. A mutation can include an insertion of one or more nucleotides or base pairs. A mutation can include a deletion of one or more nucleotides or base pairs. A mutation can include a substitution of one or more nucleotides or base pairs for a different one or more nucleotides or base pairs. Inserted or substituted sequences can include exogenous or heterologous sequences.

An editing cassette can comprise a polynucleotide encoding a guide nucleic acid sequence. In some cases, the guide nucleic acid sequence is optionally operably linked to a promoter. A guide nucleic acid sequence can comprise a scaffold sequence and a guide sequence as described herein.

An editing cassette can comprise a barcode. A barcode can be a unique DNA sequence that corresponds to the editing sequence such that the barcode can identify the one or more mutations of the corresponding editing sequence. In some examples, the barcode is 15 nucleotides. The barcode can comprise less than 10, 10, 11, 12, 13, 14, 15, 16, 17, 18, 19, 20, 25, 30, 35, 40, 45, 50, 55, 60, 65, 70, 75, 80, 88, 90, 100, 110, 120, 130, 140, 150, 160, 170, 180, 190, 200, or more than 200 nucleotides. A barcode can be a non-naturally occurring sequence. An editing cassette comprising a barcode can be a non-naturally occurring sequence.

An editing cassette can comprise one or more of an editing sequence and a polynucleotide encoding a guide nucleic acid optionally operably linked to a promoter, wherein the editing cassette and guide nucleic acid sequence are flanked by primer sites. An editing cassette can further comprise a barcode.

Figure 3:
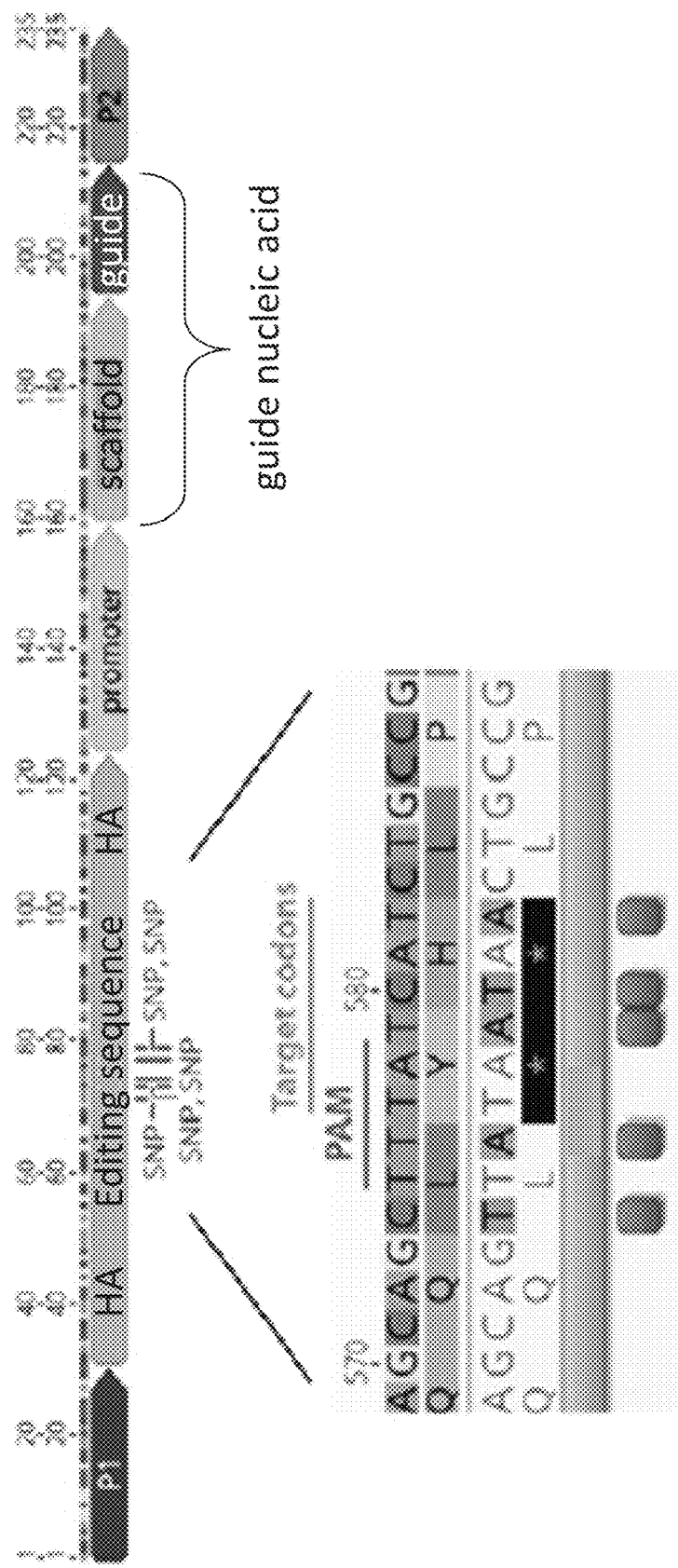
FIG. 3 depicts an example editing cassette.

An example of an editing cassette is depicted in FIG. 3. Each editing cassette can be designed to edit a site in a target sequence Sites to be targeted can be coding regions, non-coding regions, functionally neutral sites, or they can be a screenable or selectable marker gene. Homology regions within the editing sequence flank the one or more mutations of the editing cassette and can be inserted into the target sequence by recombination. Recombination can comprise DNA cleavage, such as by an nucleic acid-guided nuclease, and repair via homologous recombination.

Editing cassettes can be generated by chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof.

Trackable sequences, such as barcodes or recorder sequences, can be designed in silico via standard code with a degenerate mutation at the target codon. The degenerate mutation can comprise 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more than 30 nucleic acid residues. In some examples, the degenerate mutations can comprise 15 nucleic acid residues (N15).

Homology arms can be added to an editing sequence to allow incorporation of the editing sequence into the desired location via homologous recombination or homology-driven repair. Homology arms can be added by synthesis, in vitro assembly, PCR, or other known methods in the art. For example, chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof. A homology arm can be added to both ends of a barcode, recorder sequence, and/or editing sequence, thereby flanking the sequence with two distinct homology arms, for example, a 5' homology arm and a 3' homology arm.

A homology arm can comprise sequence homologous to a target sequence. A homology arm can comprise sequence homologous to sequence adjacent to a target sequence. A homology arm can comprise sequence homologous to sequence upstream or downstream of a target sequence. A homology arm can comprise sequence homologous to sequence within the same gene or open reading frame as a target sequence. A homology arm can comprise sequence homologous to sequence upstream or downstream of a gene or open reading frame the target sequence is within. A homology arm can comprise sequence homologous to a 5' UTR or 3' UTR of a gene or open reading frame within which is a target sequence. A homology arm can comprise sequence homologous to a different gene, open reading frame, promoter, terminator, or nucleic acid sequence than that which the target sequence is within.

The same 5' and 3' homology arms can be added to a plurality of distinct editing sequences, thereby generating a library of unique editing sequences that each have the same targeted insertion site. The same 5' and 3' homology arms can be added to a plurality of distinct editing templates, thereby generating a library of unique editing templates that each have the same targeted insertion site. In alternative examples, different or a variety of 5' or 3' homology arms can be added to a plurality of editing sequences or editing templates.

A barcode library or recorder sequence library comprising flanking homology arms can be cloned into a vector backbone. In some examples, the barcode comprising flanking homology arms are cloned into an editing cassette. Cloning can occur by chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof.

An editing sequence library comprising flanking homology arms can be cloned into a vector backbone. In some examples, the editing sequence and homology arms are cloned into an editing cassette. Editing cassettes can, in some cases, further comprise a nucleic acid sequence encoding a guide nucleic acid or gRNA engineered to target the desired site of editing sequence insertion, e.g. the target sequence. Editing cassettes can, in some cases, further comprise a barcode or recorder sequence. Cloning can occur by chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof.

Gene-wide or genome-wide editing libraries can be cloned into a vector backbone. A barcode or recorder sequence library can be inserted or assembled into a second site to generate competent trackable plasmids that can embed the recording barcode at a fixed locus while integrating the editing libraries at a wide variety of user defined sites. Cloning can occur by chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof.

A guide nucleic acid or sequence encoding the same can be assembled or inserted into a vector backbone first, followed by insertion of an editing sequence and/or cassette. In other cases, an editing sequence and/or cassette can be inserted or assembled into a vector backbone first, followed by insertion of a guide nucleic acid or sequence encoding the same. In other cases, guide nucleic acid or sequence encoding the same and an editing sequence and/or cassette are simultaneous inserted or assembled into a vector. A recorder sequence or barcode can be inserted before or after any of these steps. In other words, it should be understood that there are many possible permutations to the order in which elements of the disclosure are assembled. The vector can be linear or circular and can be generated by chemical synthesis, Gibson assembly, SLIC, CPEC, PCA, ligation-free cloning, overlapping oligo extension, in vitro assembly, in vitro oligo assembly, PCR, traditional ligation-based cloning, other known methods in the art, or any combination thereof.

A nucleic acid molecule can be synthesized which comprises one or more elements disclosed herein. A nucleic acid molecule can be synthesized that comprises an editing cassette. A nucleic acid molecule can be synthesized that comprises a guide nucleic acid. A nucleic acid molecule can be synthesized that comprises a recorder cassette. A nucleic acid molecule can be synthesized that comprises a barcode. A nucleic acid molecule can be synthesized that comprises a homology arm. A nucleic acid molecule can be synthesized that comprises an editing cassette and a guide nucleic acid. A nucleic acid molecule can be synthesized that comprises an editing cassette and a barcode. A nucleic acid molecule can be synthesized that comprises an editing cassette, a guide nucleic acid, and a recorder cassette. A nucleic acid molecule can be synthesized that comprises an editing cassette, a recorder cassette, and two guide nucleic acids. A nucleic acid molecule can be synthesized that comprises a recorder cassette and a guide nucleic acid. In any of these cases, the guide nucleic acid can optionally be operably linked to a promoter. In any of these cases, the nucleic acid molecule can further include one or more barcodes.

Synthesis can occur by any nucleic acid synthesis method known in the art. Synthesis can occur by enzymatic nucleic acid synthesis. Synthesis can occur by chemical synthesis. Synthesis can occur by array-based synthesis. Synthesis can occur by solid-phase synthesis or phosphoramidite methods. Synthesis can occur by column or multi-well methods. Synthesized nucleic acid molecules can be non-naturally occurring nucleic acid molecules.

Software and automation methods can be used for multiplex synthesis and generation. For example, software and automation can be used to create $10$, $10^2$, $10^3$, $10^4$, $10^5$, $10^6$, or more synthesized polynucleotides, cassettes, or plasmids. An automation method can generate desired sequences and libraries in rapid fashion that can be processed through a workflow with minimal steps to produce precisely defined libraries, such as gene-wide or genome-wide editing libraries.

Polynucleotides or libraries can be generated which comprise two or more nucleic acid molecules or plasmids comprising any combination disclosed herein of recorder sequence, editing sequence, guide nucleic acid, and optional barcode, including combinations of one or more of any of the previously mentioned elements. For example, such a library can comprise at least 2, 3, 4, 5, 10, 20, 30, 40, 50, 60, 70, 80, 90, 100, 200, 300, 400, 500, 600, 700, 800, 1000, 1500, 2000, 2500, 3000, 3500, 4000, 4500, 5000, 5500, 6000, 6500, 7000, 7500, 8000, 8500, 9000, 9500, $10^4$, $10^5$, $10^6$, $10^7$, $10^8$, $10^9$, $10^{10}$, or more nucleic acid molecules or plasmids of the present disclosure. It should be understood that such a library can include any number of nucleic acid molecules or plasmids, even if the specific number is not explicit listed above.

Trackable plasmid libraries or nucleic acid molecule libraries can be sequenced in order to determine the recorder sequence and editing sequence pair that is comprised on each trackable plasmid. In other cases, a known recorder sequence is paired with a known editing sequence during the library generation process. Other methods of determining the association between a recorder sequence and editing sequence comprised on a common nucleic acid molecule or plasmid are envisioned such that the editing sequence can be identified by identification or sequencing of the recorder sequence.

Methods and compositions for tracking edited episomal libraries that are shuttled between E. coli and other organisms/cell lines are provided herein. The libraries can be comprised on plasmids, Bacterial artificial chromosomes (BACs), Yeast artificial chromosomes (YACs), synthetic chromosomes, or viral or phage genomes. These methods and compositions can be used to generate portable barcoded libraries in host organisms, such as E. coli. Library generation in such organisms can offer the advantage of established techniques for performing homologous recombination. Barcoded plasmid libraries can be deep-sequenced at one site to track mutational diversity targeted across the remaining portions of the plasmid allowing dramatic improvements in the depth of library coverage.

Any nucleic acid molecule disclosed herein can be an isolated nucleic acid. Isolated nucleic acids may be made by any method known in the art, for example using standard recombinant methods, assembly methods, synthesis techniques, or combinations thereof. In some embodiments, the nucleic acids may be cloned, amplified, assembled, or otherwise constructed.

Isolated nucleic acids may be obtained from cellular, bacterial, or other sources using any number of cloning methodologies known in the art. In some embodiments, oligonucleotide probes which selectively hybridize, under stringent conditions, to other oligonucleotides or to the nucleic acids of an organism or cell can be used to isolate or identify an isolated nucleic acid.

Cellular genomic DNA, RNA, or cDNA may be screened for the presence of an identified genetic element of interest using a probe based upon one or more sequences. Various degrees of stringency of hybridization may be employed in the assay.

High stringency conditions for nucleic acid hybridization are well known in the art. For example, conditions may comprise low salt and/or high temperature conditions, such as provided by about 0.02 M to about 0.15 M NaCl at temperatures of about 50° C. to about 70° C. It is understood that the temperature and ionic strength of a desired stringency are determined in part by the length of the particular nucleic acid(s), the length and nucleotide content of the target sequence(s), the charge composition of the nucleic acid(s), and by the presence or concentration of formamide, tetramethylammonium chloride or other solvent(s) in a hybridization mixture. Nucleic acids may be completely complementary to a target sequence or may exhibit one or more mismatches.

Nucleic acids of interest may also be amplified using a variety of known amplification techniques. For instance, polymerase chain reaction (PCR) technology may be used to amplify target sequences directly from DNA, RNA, or cDNA. PCR and other in vitro amplification methods may also be useful, for example, to clone nucleic acid sequences, to make nucleic acids to use as probes for detecting the presence of a target nucleic acid in samples, for nucleic acid sequencing, or for other purposes.

Isolated nucleic acids may be prepared by direct chemical synthesis by methods such as the phosphotriester method, or using an automated synthesizer. Chemical synthesis generally produces a single stranded oligonucleotide. This may be converted into double stranded DNA by hybridization with a complementary sequence or by polymerization with a DNA polymerase using the single strand as a template.

Recorder

In some example, two editing cassettes can be used together to track a genetic engineering step. For example, one editing cassette can comprise an editing template and an encoded guide nucleic acid, and a second editing cassette, referred to as a recorder cassette, can comprise an editing template comprising a recorder sequence and an encoded nucleic acid which has a distinct guide sequence compared to that of the first editing cassette. In such cases, the editing sequence and the recorder sequence can be inserted into separate target sequences and determined by their corresponding guide nucleic acids. A recorder sequence can comprise a barcode, trackable or traceable sequence, and/or a regulatory element operable with a screenable or selectable marker.

Through a multiplexed cloning approach, the recorder cassette can be covalently coupled to at least one editing cassette in a plasmid (e.g., FIG. 17A, green cassette) to generate plasmid libraries that have a unique recorder and editing cassette combination. This library can be sequenced to generate the recorder/edit mapping and used to track editing libraries across large segments of the target DNA (e.g., FIG. 17C). Recorder and editing sequences can be comprised on the same cassette, in which case they are both incorporated into the target nucleic acid sequence, such as a genome or plasmid, by the same recombination event. In other examples, the recorder and editing sequences can be comprised on separate cassettes within the same plasmid, in which case the recorder and editing sequences are incorporated into the target nucleic acid sequence by separate recombination events, either simultaneously or sequentially.

Methods are provided herein for combining multiplex oligonucleotide synthesis with recombineering, to create libraries of specifically designed and trackable mutations. Screens and/or selections followed by high-throughput sequencing and/or barcode microarray methods can allow for rapid mapping of mutations leading to a phenotype of interest.

Methods and compositions disclosed herein can be used to simultaneously engineer and track engineering events in a target nucleic acid sequence.

Such plasmids can be generated using in vitro assembly or cloning techniques. For example, the plasmids can be generated using chemical synthesis, Gibson assembly, SLIC, CPEC, PCA, ligation-free cloning, other in vitro oligo assembly techniques, traditional ligation-based cloning, or any combination thereof.

Such plasmids can comprise at least one recording sequence, such as a barcode, and at least one editing sequence. In most cases, the recording sequence is used to record and track engineering events. Each editing sequence can be used to incorporate a desired edit into a target nucleic acid sequence. The desired edit can include insertion, deletion, substitution, or alteration of the target nucleic acid sequence. In some examples, the one or more recording sequence and editing sequences are comprised on a single cassette comprised within the plasmid such that they are incorporated into the target nucleic acid sequence by the same engineering event. In other examples, the recording and editing sequences are comprised on separate cassettes within the plasmid such that they are each incorporated into the target nucleic acid by distinct engineering events. In some examples, the plasmid comprises two or more editing sequences. For example, one editing sequence can be used to alter or silence a PAM sequence while a second editing sequence can be used to incorporate a mutation into a distinct sequence.

Recorder sequences can be inserted into a site separated from the editing sequence insertion site. The inserted recorder sequence can be separated from the editing sequence by 1 bp to 1 Mbp. For example, the separation distance can be about 1 bp, 10 bp, 50 bp, 100 bp, 500 bp, 1 kp, 2 kb, 5 kb, 10 kb, or greater. The separation distance can be any discrete integer between 1 bp and 10 Mbp. In some examples, the maximum distance of separation depends on the size of the target nucleic acid or genome.

Recorder sequences can be inserted adjacent to editing sequences, or within proximity to the editing sequence. For example, the recorder sequence can be inserted outside of the open reading frame within which the editing sequence is inserted. Recorder sequence can be inserted into an untranslated region adjacent to an open reading frame within which an editing sequence has been inserted. The recorder sequence can be inserted into a functionally neutral or non-functional site. The recorder sequence can be inserted into a screenable or selectable marker gene.

In some examples, the target nucleic acid sequence is comprised within a genome, artificial chromosome, synthetic chromosome, or episomal plasmid. In various examples, the target nucleic acid sequence can be in vitro or in vivo. When the target nucleic acid sequence is in vivo, the plasmid can be introduced into the host organisms by transformation, transfection, conjugation, biolistics, nanoparticles, cell-permeable technologies, or other known methods for DNA delivery, or any combination thereof. In such examples, the host organism can be a eukaryote, prokaryote, bacterium, archaea, yeast, or other fungi.

The engineering event can comprise recombineering, non-homologous end joining, homologous recombination, or homology-driven repair. In some examples, the engineering event is performed in vitro or in vivo.

The methods described herein can be carried out in any type of cell in which a targetable nuclease system can function (e.g., target and cleave DNA), including prokaryotic and eukaryotic cells. In some embodiments the cell is a bacterial cell, such as *Escherichia* spp. (e.g., *E. coli*). In other embodiments, the cell is a fungal cell, such as a yeast cell, e.g., *Saccharomyces* spp. In other embodiments, the cell is an algal cell, a plant cell, an insect cell, or a mammalian cell, including a human cell.

In some examples, the cell is a recombinant organism. For example, the cell can comprise a non-native targetable nuclease system. Additionally or alternatively, the cell can comprise recombination system machinery. Such recombination systems can include lambda red recombination system, Cre/Lox, attB/attP, or other integrase systems. Where appropriate, the plasmid can have the complementary components or machinery required for the selected recombination system to work correctly and efficiently.

Method for genome editing can comprise: (a) introducing a vector that encodes at least one editing cassette and at least one guide nucleic acid into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage and incorporation of the editing cassette; (c) obtaining viable cells; and (d) sequencing the target DNA molecule in at least one cell of the second population of cells to identify the mutation of at least one codon.

A method for genome editing can comprise: (a) introducing a vector that encodes at least one editing cassette comprising a PAM mutation as disclosed herein and at least one guide nucleic acid into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage, incorporation of the editing cassette, and death of cells of the second population of cells that do not comprise the PAM mutation, whereas cells of the second population of cells that comprise the PAM mutation are viable; (c) obtaining viable cells; and (d) sequencing the target DNA in at least one cell of the second population of cells to identify the mutation of at least one codon.

Method for trackable genome editing can comprise: (a) introducing a vector that encodes at least one editing cassette, at least one recorder cassette, and at least two guide nucleic acids into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage and incorporation of the editing and recorder cassettes; (c) obtaining viable cells; and (d) sequencing the recorder sequence of the target DNA molecule in at least one cell of the second population of cells to identify the mutation of at least one codon.

In some examples where the plasmid comprises a second editing sequence designed to silence a PAM, a method for trackable genome editing can comprise: (a) introducing a vector that encodes at least one editing cassette, a recorder cassette, and at least two guide nucleic acids into a first population of cells, thereby producing a second population of cells comprising the vector; (b) maintaining the second population of cells under conditions in which a nucleic acid-guided nuclease is expressed or maintained, wherein the nucleic acid-guided nuclease is encoded on the vector, a second vector, on the genome of cells of the second population of cells, or otherwise introduced into the cell, resulting in DNA cleavage, incorporation of the editing and recorder cassettes, and death of cells of the second population of cells that do not comprise the PAM mutation, whereas cells of the second population of cells that comprise the PAM mutation are viable; (c) obtaining viable cells; and (d) sequencing the recorder sequence of the target DNA in at least one cell of the second population of cells to identify the mutation of at least one codon.

In some examples transformation efficiency is determined by using a non-targeting control guide nucleic acid, which allows for validation of the recombineering procedure and CFU/ng calculations. In some cases, absolute efficient is obtained by counting the total number of colonies on each transformation plate, for example, by counting both red and white colonies from a galK control. In some examples, relative efficiency is calculated by the total number of successful transformants (for example, white colonies) out of all colonies from a control (for example, galK control).

The methods of the disclosure can provide, for example, greater than 1000× improvements in the efficiency, scale, cost of generating a combinatorial library, and/or precision of such library generation.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the efficiency of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the scale of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater decrease in the cost of generating genomic or combinatorial libraries.

The methods of the disclosure can provide, for example, greater than: 10×, 50×, 100×, 200×, 300×, 400×, 500×, 600×, 700×, 800×, 900×, 1000×, 1100×, 1200×, 1300×, 1400×, 1500×, 1600×, 1700×, 1800×, 1900×, 2000×, or greater improvements in the precision of genomic or combinatorial library generation.

Recursive Tracking for Combinatorial Engineering

Disclosed herein are methods and compositions for iterative rounds of engineering. Disclosed herein are recursive engineering strategies that allow implementation of CREATE recording at the single cell level through several serial engineering cycles (e.g., FIG. 18 and FIG. 19). These disclosed methods and compositions can enable search-based technologies that can effectively construct and explore complex genotypic space. The terms recursive and iterative can be used interchangeably.

Combinatorial engineering methods can comprise multiple rounds of engineering. Methods disclosed herein can comprise 2 or more rounds of engineering. For example, a method can comprise 2, 3, 4, 5, 6, 7, 8, 9, 10, 11, 12, 13, 14, 15, 20, 25, 30, or more than 30 rounds of engineering.

In some examples, during each round of engineering a new recorder sequence, such as a barcode, is incorporated at the same locus in nearby sites (e.g., FIG. 18, green bars or FIG. 19, black bars) such that following multiple engineering cycles to construct combinatorial diversity throughout the genome (e.g., FIG. 18, green bars or FIG. 19, grey bars) a simple PCR of the recording locus can be used to reconstruct each combinatorial genotype or to confirm that the engineered edit from each round has been incorporated into the target site.

Disclosed herein are methods for selecting for successive rounds of engineering. Selection can occur by a PAM mutation incorporated by an editing cassette. Selection can occur by a PAM mutation incorporated by a recorder cassette. Selection can occur using a screenable, selectable, or counter-selectable marker. Selection can occur by targeting a site for editing or recording that was incorporated by a prior round of engineering, thereby selecting for variants that successfully incorporated edits and recorder sequences from both rounds or all prior rounds of engineering.

Quantitation of these genotypes can be used for understanding combinatorial mutational effects on large populations and investigation of important biological phenomena such as epistasis.

Serial editing and combinatorial tracking can be implemented using recursive vector systems as disclosed herein. These recursive vector systems can be used to move rapidly through the transformation procedure. In some examples, these systems consist of two or more plasmids containing orthogonal replication origins, antibiotic markers, and an encoded guide nucleic acids. The encoded guide nucleic acid in each vector can be designed to target one of the other resistance markers for destruction by nucleic acid-guided nuclease-mediated cleavage. These systems can be used, in some examples, to perform transformations in which the antibiotic selection pressure is switched to remove the previous plasmid and drive enrichment of the next round of engineered genomes. Two or more passages through the transformation loop can be performed, or in other words, multiple rounds of engineering can be performed. Introducing the requisite recording cassettes and editing cassettes into recursive vectors as disclosed herein can be used for simultaneous genome editing and plasmid curing in each transformation step with high efficiencies.

In some examples, the recursive vector system disclosed herein comprises 2, 3, 4, 5, 6, 7, 8, 9, 10, or more than 10 unique plasmids. In some examples, the recursive vector system can use a particular plasmid more than once as long as a distinct plasmid is used in the previous round and in the subsequent round.

Recursive methods and compositions disclosed herein can be used to restore function to a selectable or screenable element in a targeted genome or plasmid. The selectable or screenable element can include an antibiotic resistance gene, a fluorescent gene, a unique DNA sequence or watermark, or other known reporter, screenable, or selectable gene. In some examples, each successive round of engineering can incorporate a fragment of the selectable or screenable element, such that at the end of the engineering rounds, the entire selectable or screenable element has been incorporated into the target genome or plasmid. In such examples, only those genome or plasmids which have successfully incorporated all of the fragments, and therefore all of the desired corresponding mutations, can be selected or screened for. In this way, the selected or screened cells will be enriched for those that have incorporated the edits from each and every iterative round of engineering.

Recursive methods can be used to switch a selectable or screenable marker between an on and an off position, or between an off and an on position, with each successive round of engineering. Using such a method allows conservation of available selectable or screenable markers by requiring, for example, the use of only one screenable or selectable marker. Furthermore, short regulatory sequence or start codon or non-start codons can be used to turn the screenable or selectable marker on and off. Such short sequences can easily fit within a synthesized cassette or polynucleotide.

One or more rounds of engineering can be performed using the methods and compositions disclosed herein. In some examples, each round of engineering is used to incorporate an edit unique from that of previous rounds. Each round of engineering can incorporate a unique recording sequence. Each round of engineering can result in removal or curing of the plasmid used in the previous round of engineering. In some examples, successful incorporation of the recording sequence of each round of engineering results in a complete and functional screenable or selectable marker or unique sequence combination.

Unique recorder cassettes comprising recording sequences such as barcodes or screenable or selectable markers can be inserted with each round of engineering, thereby generating a recorder sequence that is indicative of the combination of edits or engineering steps performed. Successive recording sequences can be inserted adjacent to one another. Successive recording sequences can be inserted within proximity to one another. Successive sequences can be inserted at a distance from one another.

Successive sequences can be inserted at a distance from one another. For example, successive recorder sequences can be inserted and separated by 0, 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 78, 79, 80, 81, 82, 83, 84, 85, 86, 87, 88, 89, 90, 91, 92, 93, 94, 95, 96, 97, 98, 99, 100, or greater than 100 bp. In some examples, successive recorder sequences are separated by about 10, 50, 100, 150, 200, 250, 300, 350, 400, 450, 500, 550, 600, 650, 700, 750, 800, 850, 900, 950, 1000, 1100, 1200, 1300, 1400, 1500, or greater than 1500 bp.

Successive recorder sequences can be separated by any desired number of base pairs and can be dependent and limited on the number of successive recorder sequences to be inserted, the size of the target nucleic acid or target genomes, and/or the design of the desired final recorder sequence. For example, if the compiled recorder sequence is a functional screenable or selectable marker, than the successive recording sequences can be inserted within proximity and within the same reading frame from one another. If the compiled recorder sequence is a unique set of barcodes to be identified by sequencing and have no coding sequence element, then the successive recorder sequences can be inserted with any desired number of base pairs separating them. In these cases, the separation distance can be dependent on the sequencing technology to be used and the read length limit.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Some Definitions

As used herein the term "wild type" is a term of the art understood by skilled persons and means the typical form of an organism, strain, gene or characteristic as it occurs in nature as distinguished from mutant or variant forms.

As used herein the term "variant" should be taken to mean the exhibition of qualities that have a pattern that deviates from what occurs in nature.

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.).

The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

"Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993). Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridising to the reference sequence under highly stringent conditions. Generally, in order to maximize the hybridization rate, relatively low-stringency hybridization conditions are selected: about 20 to 25 degrees Celsius. lower than the thermal melting point (Tm). The Tm is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15 degrees Celsius lower than the Tm. In order to require at least about 70% nucleotide complementarity of hybridized sequences, moderately-stringent washing conditions are selected to be about 15 to 30 degrees Celsius lower than the Tm. Highly permissive (very low stringency) washing conditions may be as low as 50 degrees Celsius below the Tm, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

As used herein, the term "domain" or "protein domain" refers to a part of a protein sequence that may exist and function independently of the rest of the protein chain.

As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. Sequence homologies may be generated by any of a number of computer programs known in the art, for example BLAST or FASTA, etc. A suitable computer program for carrying out such an alignment is the GCG Wisconsin Bestfit package (University of Wisconsin. U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program.

Percent homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues.

Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity.

However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension.

Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p 387). Examples of other software that may perform sequence comparisons include, but are not limited to, the BLAST package (see Ausubel et al., 1999 Short Protocols in Molecular Biology, 4th Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177(1): 187-8 and the website of the National Center for Biotechnology information at the website of the National Institutes for Health).

Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62.

Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result.

Sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids.

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyridylalanine, thienylalanine, naphthylalanine and phenylglycine.

Variant amino acid sequences may include suitable spacer groups that may be inserted between any two amino acid residues of the sequence including alkyl groups such as methyl, ethyl or propyl groups in addition to amino acid spacers such as glycine or .beta.-alanine residues. A further form of variation, which involves the presence of one or more amino acid residues in peptoid form, may be well understood by those skilled in the art. For the avoidance of doubt, "the peptoid form" is used to refer to variant amino acid residues wherein the .alpha.-carbon substituent group is on the residue's nitrogen atom rather than the .alpha.-carbon. Processes for preparing peptides in the peptoid form are known in the art, for example Simon R J et al., PNAS (1992) 89(20), 9367-9371 and Horwell D C, Trends Biotechnol. (1995) 13(4), 132-134.

The practice of the present invention employs, unless otherwise indicated, conventional techniques of immunology, biochemistry, chemistry, molecular biology, microbiology, cell biology, genomics and recombinant DNA, which are within the skill of the art. See Green and Sambrook, (*Molecular Cloning: A Laboratory Manual*. 4th, ed., Cold Spring Harbor Laboratory Press, Cold Spring Harbor, N.Y., 2014); CURRENT PROTOCOLS IN MOLECULAR BIOLOGY (F. M. Ausubel, et al. eds., (2017)); Short Protocols in Molecular Biology, (Ausubel et al., 1999)); the series METHODS IN ENZYMOLOGY (Academic Press, Inc.): PCR 2: A PRACTICAL APPROACH (M. J. MacPherson, B. D. Hames and G. R. Taylor eds. (1995)), ANTIBODIES, A LABORATORY MANUAL, SECOND EDITION (Harlow and Lane, eds. (2014) and CULTURE OF ANIMAL CELLS: A MANUAL OF BASIC TECHNIQUE, 7TH EDITION (R. I. Freshney, ed. (2016)).

EXAMPLES

The following examples are given for the purpose of illustrating various embodiments of the invention and are not meant to limit the present invention in any fashion. The present examples, along with the methods described herein are presently representative of preferred embodiments, are exemplary, and are not intended as limitations on the scope of the invention. Changes therein and other uses which are encompassed within the spirit of the invention as defined by the scope of the claims will occur to those skilled in the art.

Example 1. Nucleic Acid-Guided Nucleases

Sequences for twenty nucleic acid guided nucleases, termed MAD1-MAD20 (SEQ ID NOs 1-20), were aligned and compared to other nucleic acid guided nucleases. A partial alignment and phylogenetic tree are depicted in FIG. 1A and FIG. 1B respectively. Key residues in that may be involved in the recognition of a PAM site are shown in FIG. 1A. These include amino acids at positions 167, 539, 548, 599, 603, 604, 605, 606, and 607.

Sequence alignments were built using PSI-BLAST to search for MAD nuclease homologs in the NCBI non-redundant databases. Multiple sequence alignments were further refined using the MUSCLE alignment algorithm with default settings as implemented in Geneious 10. The percent identity of each homolog to SpCas9 and AsCpf1 reference sequences were computed based on the pairwise alignment matching from these global alignments.

Genomic source sequences were identified using Uniprot linkage information or TBLASTN searches of NCBI using the default parameters and searching all possible frames for translational matches.

Percent identities of MAD1-8 and 10-12 to other various nuclease are summarized in Table 1. These percent identities represent the shared amino acid sequence identity between the indicated proteins.

TABLE 1

| Protein identifier or accession number | MAD1 | MAD2 | MAD3 | MAD4 | MAD5 | MAD6 | MAD7 | MAD8 | MAD10 | MAD11 | MAD12 |
| --- | --- | --- | --- | --- | --- | --- | --- | --- | --- | --- | --- |
| gi\|1025734861\|pdb\|5B43\|A | 6.4 | 32.8 | 33.2 | 29.7 | 29.4 | 31.1 | 30.3 | 31.7 | 26.7 | 27.9 | 98.8 |
| gi\|1052245173\|pdb\|5KK5\|A | 6.4 | 32.7 | 33.1 | 29.7 | 29.3 | 31 | 30.3 | 31.7 | 26.7 | 27.8 | 98.7 |
| gi\|1086216683\|emb\|SDC16215.1\| | 6.1 | 33 | 34.4 | 29.6 | 30.1 | 33.5 | 32.3 | 32.1 | 26.2 | 27.2 | 46.8 |
| gi\|1120175333\|ref\|WP_073043853.1\| | 5.9 | 30.9 | 37.2 | 32.8 | 33.6 | 34.4 | 35.7 | 35.1 | 26.3 | 28.3 | 34.9 |

TABLE 1-continued

| Protein identifier or accession number | MAD1 | MAD2 | MAD3 | MAD4 | MAD5 | MAD6 | MAD7 | MAD8 | MAD10 | MAD11 | MAD12 |
|---|---|---|---|---|---|---|---|---|---|---|---|
| Cpf1.Sj\|WP_081839471 | 6.6 | 33.6 | 41.7 | 37.2 | 33.4 | 37.6 | 40.1 | 37.7 | 29.1 | 30.3 | 34.1 |
| Cpf1.Ss\|KFO67989 | 6.9 | 32.3 | 35.7 | 43 | 33.7 | 45.9 | 34.8 | 48 | 33.2 | 33.4 | 33.8 |
| MAD3 | 5.8 | 31 | 100 | 32.9 | 35.9 | 35 | 35.6 | 34.3 | 28 | 27.6 | 33.1 |
| gi\|1082474576\|gb\|OFY19591.1\| | 7 | 31.4 | 35.9 | 43.2 | 31.4 | 45 | 33.6 | 48.6 | 30.8 | 33.5 | 33 |
| MAD2 | 6.1 | 100 | 31 | 30.7 | 30.2 | 31 | 31.2 | 31.2 | 25.8 | 27.7 | 32.6 |
| Cpf1.Lb5\|WP_016301126 | 7.8 | 32.8 | 36.5 | 38.2 | 34.2 | 45.5 | 35.8 | 43.6 | 30.7 | 35.7 | 32.5 |
| gi\|1088286736\|gb\|OHB41002.1\| | 6.7 | 30.6 | 35.3 | 42.4 | 33.2 | 44.7 | 32.1 | 46.8 | 30.7 | 32.6 | 32.4 |
| gi\|1094423310\|emb\|SER03894.1\| | 6.8 | 30.8 | 36.1 | 40.4 | 31.8 | 50.4 | 35.2 | 46.6 | 30.4 | 36.8 | 32.3 |
| gi\|493326531\|ref\|WP_006283774.1\| | 6.8 | 30.8 | 36.1 | 40.3 | 31.8 | 50.3 | 35.1 | 46.6 | 30.4 | 36.8 | 32.3 |
| MAD8 | 7.6 | 31.2 | 34.3 | 40.4 | 32 | 41.6 | 32.8 | 100 | 30.1 | 32.1 | 31.7 |
| Cpf1.Bot\|WP_009217842 | 6.9 | 30.1 | 36.6 | 41.5 | 32.5 | 50.2 | 35.4 | 45.5 | 29.8 | 34.1 | 31.6 |
| Cpf1.Li\|WP_020988726 | 7.3 | 30.2 | 34.6 | 39.3 | 30.3 | 40.7 | 31.8 | 39.4 | 32.1 | 31.3 | 31.5 |
| Cpf1.Pb\|WP_044110123 | 6.3 | 31.4 | 31.8 | 36.1 | 30.8 | 45.7 | 30.4 | 39.4 | 27.7 | 33.5 | 31.5 |
| gi\|817911372\|gb\|AKG08867.1\| | 7.3 | 29.8 | 35 | 40.7 | 32.1 | 40.3 | 32.6 | 41.7 | 29.1 | 31 | 31.4 |
| gi\|1052838533\|emb\|SCH45297.1\| | 6.6 | 30.8 | 35.5 | 32 | 31.5 | 34.4 | 51.9 | 33.4 | 26.1 | 29 | 31.3 |
| gi\|1053713332\|ref\|WP_066040075.1\| | 7.2 | 29.6 | 33.2 | 39.6 | 29.8 | 49.1 | 32.2 | 41.4 | 30.1 | 32.4 | 31.3 |
| gi\|817909002\|gb\|AKG06878.1\| | 7.3 | 29.8 | 35 | 40.7 | 32 | 40.3 | 32.5 | 41.6 | 29.1 | 30.9 | 31.3 |
| gi\|1042201477\|ref\|WP_065256572.1\| | 7.2 | 29.5 | 35.2 | 40.6 | 31.9 | 40.1 | 32.7 | 41.6 | 29 | 30.8 | 31.2 |
| MAD6 | 7.5 | 31 | 35 | 38.9 | 33.1 | 100 | 34.3 | 41.6 | 30.5 | 33.6 | 31 |
| gi\|490468773\|ref\|WP_004339290.1\| | 6.8 | 31.8 | 31.7 | 36.2 | 28.6 | 36.5 | 31.4 | 38.4 | 28.5 | 31.4 | 31 |
| gi\|565853704\|ref\|WP_023936172.1\| | 7.5 | 30.8 | 34.9 | 38.9 | 33.1 | 99.7 | 34.1 | 41.6 | 30.4 | 33.6 | 31 |
| gi\|739005707\|ref\|WP_036887416.1\| | 7.5 | 30.9 | 35 | 38.9 | 33 | 99.9 | 34.2 | 41.5 | 30.4 | 33.5 | 31 |
| gi\|739008549\|ref\|WP_036890108.1\| | 7.5 | 31 | 35 | 38.8 | 33 | 99.8 | 34.2 | 41.5 | 30.4 | 33.5 | 31 |
| Cpf1.Ft\|WP_014550095 | 7.1 | 31.9 | 33.8 | 40.3 | 29.7 | 39.4 | 34.1 | 41 | 29.8 | 32.5 | 30.8 |
| gi\|504362993\|ref\|WP_014550095.1\| | 7.2 | 32.4 | 33.8 | 40.3 | 29.6 | 39.4 | 33.8 | 40.9 | 30.1 | 32.5 | 30.8 |
| gi\|640557447\|ref\|WP_024988992.1\| | 6.6 | 31.4 | 34.8 | 40.7 | 31.2 | 48 | 34.1 | 45.1 | 28.8 | 35.2 | 30.7 |
| gi\|1098944113\|ref\|WP_071304624.1\| | 7.1 | 32.3 | 33.5 | 40.3 | 29.6 | 39.2 | 33.8 | 40.9 | 30.1 | 32.5 | 30.6 |
| gi\|489124848\|ref\|WP_003034647.1\| | 7.1 | 32.3 | 33.9 | 40.9 | 29.9 | 39.2 | 33.9 | 40.9 | 29.9 | 32.2 | 30.6 |
| gi\|738967776\|ref\|WP_036851563.1\| | 6.8 | 29.4 | 33.1 | 35.5 | 28.9 | 40.3 | 30.7 | 35.9 | 28.7 | 31.3 | 30.5 |
| MAD7 | 5.9 | 31.2 | 35.6 | 33.9 | 34.3 | 100 | 32.8 | 24.2 | 28.9 | 30.5 | |
| Cpf1.Lb6\|WP_044910713 | 6.7 | 29.8 | 33.7 | 36.6 | 30.9 | 43 | 34 | 39.8 | 29.1 | 32.1 | 30.4 |
| gi\|1052961977\|emb\|SCH47915.1\| | 5.5 | 30.5 | 35.8 | 32.3 | 34 | 35 | 53.8 | 33.4 | 26.2 | 27.4 | 30.4 |
| gi\|817918353\|gb\|AKG14689.1\| | 7 | 29.1 | 34.4 | 39.8 | 31.7 | 40 | 32.4 | 41.1 | 28.4 | 30.1 | 30.3 |
| gi\|917059416\|ref\|WP_051666128.1\| | 6.9 | 29.9 | 31.5 | 35.7 | 31.6 | 41.8 | 32.9 | 39.1 | 30.1 | 34 | 30.2 |
| gi\|1011649201\|ref\|WP_062499108.1\| | 6.8 | 29 | 34.7 | 40.3 | 31.4 | 40.1 | 33.1 | 41.6 | 28.5 | 30.4 | 30.1 |
| Cpf1.Pm\|WP_018359861 | 6.3 | 29.2 | 32.3 | 34.2 | 27.4 | 38.7 | 29.4 | 35 | 27.2 | 30.1 | 30 |
| gi\|817922537\|gb\|AKG18099.1\| | 6.8 | 29.1 | 34.5 | 39.6 | 31.5 | 39.9 | 32.7 | 40.7 | 28.3 | 29.8 | 30 |
| gi\|769142322\|ref\|WP_044919442.1\| | 6.7 | 31 | 34.6 | 37.8 | 31.5 | 41.4 | 33.3 | 39.2 | 28 | 31.9 | 29.9 |
| gi\|1023176441\|pdb\|5ID6\|A | 6.7 | 29.7 | 33 | 35.5 | 31.3 | 41 | 32.6 | 38.5 | 29.7 | 33.3 | 29.8 |
| gi\|491540987\|ref\|WP_005398606.1\| | 5.9 | 28.3 | 30.4 | 29.7 | 28.5 | 29 | 30.7 | 29.8 | 25.8 | 27.8 | 29.8 |
| gi\|652820612\|ref\|WP_027109509.1\| | 6.4 | 31.1 | 34 | 35.3 | 31.7 | 40.3 | 33.4 | 37.5 | 28.5 | 33.3 | 29.8 |
| gi\|502240446\|ref\|WP_012739647.1\| | 5.9 | 31.6 | 36.1 | 31.2 | 33 | 35.4 | 49.4 | 34 | 26.6 | 29.4 | 29.7 |
| gi\|524278046\|emb\|CDA41776.1\| | 5.8 | 31.6 | 36 | 31 | 33 | 35.4 | 50 | 34 | 26.6 | 29.5 | 29.7 |
| gi\|737831580\|ref\|WP_035798880.1\| | 6.2 | 31.3 | 34.8 | 38.1 | 31.5 | 42.1 | 33 | 39.6 | 28.4 | 32.4 | 29.7 |
| gi\|909652572\|ref\|WP_049895985.1\| | 6.9 | 30.7 | 34.2 | 37.2 | 30.8 | 41.5 | 34.2 | 38.7 | 28 | 32 | 29.7 |
| MAD4 | 6.7 | 30.7 | 32.9 | 100 | 30.7 | 38.9 | 30.8 | 40.4 | 28.8 | 29.4 | 29.7 |
| gi\|942073049\|ref\|WP_055286279.1\| | 5.9 | 31.6 | 36.1 | 31.1 | 32.7 | 35 | 49.7 | 33.9 | 27.1 | 29.5 | 29.6 |
| gi\|654794505\|ref\|WP_028248456.1\| | 7.4 | 30.5 | 35.9 | 37.4 | 31.3 | 42.8 | 34.2 | 40.2 | 27.9 | 33.5 | 29.5 |
| gi\|933014786\|emb\|CUO47728.1\| | 5.6 | 31.3 | 34.9 | 31.2 | 31.5 | 32.4 | 46.7 | 30.6 | 25.4 | 27.7 | 29.4 |
| gi\|941887450\|ref\|WP_055224182.1\| | 5.6 | 31.4 | 35 | 31.3 | 31.6 | 32.5 | 46.6 | 30.7 | 25.3 | 27.8 | 29.4 |
| gi\|920071674\|ref\|WP_052943011.1\| | 6.3 | 31 | 31.8 | 38.8 | 31.8 | 41.3 | 33.8 | 42.6 | 29.8 | 34.7 | 29 |
| MAD5 | 5.1 | 30.2 | 35.9 | 30.7 | 100 | 33.1 | 33.9 | 32 | 24.3 | 28.7 | 29 |
| gi\|1081462674\|emb\|SCZ76797.1\| | 6.9 | 30.4 | 33.5 | 34.7 | 29.7 | 40.1 | 30.5 | 37.4 | 27.3 | 32.5 | 28.9 |
| gi\|918722523\|ref\|WP_052585281.1\| | 7.4 | 27.5 | 30.5 | 35.7 | 28.3 | 35.2 | 28.5 | 36 | 26 | 27.1 | 28.8 |
| gi\|524816323\|emb\|CDF09621.1\| | 6.2 | 30 | 34.1 | 29.3 | 31.2 | 32.7 | 47.6 | 32.2 | 25.5 | 25.9 | 28.4 |
| gi\|941782328\|ref\|WP_055176369.1\| | 6.2 | 30.2 | 33.1 | 28.9 | 30.9 | 32 | 46.9 | 32.1 | 26 | 27.1 | 28.4 |
| gi\|942113296\|ref\|WP_055306762.1\| | 6.4 | 29.8 | 33.8 | 29.7 | 31.3 | 33.1 | 48 | 32.5 | 25.8 | 26.2 | 28.4 |
| MAD11 | 6.4 | 27.7 | 27.6 | 29.4 | 28.7 | 33.6 | 28.9 | 32.1 | 26.2 | 100 | 27.8 |
| gi\|653158548\|ref\|WP_027407524.1\| | 5.9 | 26.4 | 28.1 | 33.5 | 27.4 | 32.5 | 27.8 | 32 | 27 | 26.8 | 27.6 |
| gi\|652963004\|ref\|WP_027216152.1\| | 6.6 | 30.3 | 32.5 | 33.2 | 30.4 | 38.2 | 29.6 | 34.6 | 25.9 | 30.5 | 27.2 |
| gi\|1083069650\|gb\|OGD68774.1\| | 6.2 | 25 | 24.3 | 26.6 | 23.1 | 28.1 | 23.2 | 26.4 | 45 | 24.9 | 27.1 |
| gi\|302483275\|gb\|EFL46285.1\| | 5.6 | 24.7 | 26.8 | 30.3 | 24.9 | 34.8 | 26 | 30.4 | 24.4 | 27.5 | 27.1 |
| gi\|915400855\|ref\|WP_050786240.1\| | 5.6 | 24.7 | 26.8 | 30.3 | 24.9 | 34.8 | 26 | 30.4 | 24.4 | 27.5 | 27.1 |
| MAD10 | 5.6 | 25.8 | 28 | 28.8 | 24.3 | 30.5 | 24.2 | 30.1 | 100 | 26.2 | 26.6 |
| gi\|1101117967\|gb\|OIO75780.1\| | 6.1 | 26.8 | 26 | 27.3 | 24.3 | 28.1 | 24.4 | 28.2 | 44.1 | 25.4 | 26.1 |
| gi\|1088204458\|gb\|OHA63117.1\| | 6.5 | 25.2 | 23.5 | 25.8 | 22.9 | 27 | 22 | 26.1 | 36.5 | 24.2 | 24.7 |
| gi\|809198071\|ref\|WP_046328599.1\| | 4.9 | 25.6 | 26.5 | 22.2 | 23.9 | 23.8 | 25.8 | 23.9 | 20.3 | 25.1 | 24 |
| gi\|1088079929\|gb\|OGZ45678.1\| | 5.6 | 21.9 | 23.8 | 26.9 | 23.4 | 27.8 | 23.3 | 26.7 | 28.8 | 24.7 | 23.5 |
| gi\|1101053499\|gb\|OIO15737.1\| | 5.9 | 23.1 | 26.2 | 25.2 | 23 | 26.4 | 25.1 | 26.5 | 29.2 | 23.2 | 23.4 |
| gi\|1101058058\|gb\|OIO19978.1\| | 5.4 | 21.2 | 22.8 | 23.6 | 20.6 | 25 | 20.7 | 25 | 25.9 | 22.2 | 23 |
| gi\|1088000848\|gb\|OGY73485.1\| | 5.7 | 23.5 | 25.2 | 25.5 | 23.9 | 27 | 25.1 | 25.6 | 31.6 | 23.6 | 22.9 |
| gi\|407014433\|gb\|EKE28449.1\| | 5.2 | 23.5 | 25.9 | 26.7 | 24.3 | 25.8 | 23 | 27.8 | 29.9 | 25.3 | 22.7 |
| gi\|818249855\|gb\|KKP36646.1\| | 6 | 21 | 20.7 | 23.5 | 20 | 24.2 | 21 | 24 | 24.6 | 21.8 | 22.6 |
| gi\|818703647\|gb\|KKT48220.1\| | 5.8 | 23.3 | 25 | 25.1 | 23.5 | 26.5 | 24.7 | 25.3 | 31.2 | 23.3 | 22.6 |
| gi\|818705786\|gb\|KKT50231.1\| | 5.8 | 23.1 | 24.6 | 24.7 | 22.9 | 26.2 | 24.2 | 24.8 | 30.8 | 22.9 | 22.2 |
| gi\|1083950632\|gb\|OGJ66851.1\| | 4.5 | 20 | 22.1 | 23.5 | 20.6 | 24.6 | 20 | 24 | 23.5 | 20.7 | 22.1 |
| gi\|1083932199\|gb\|OGJ49885.1\| | 6 | 20.4 | 20.2 | 22.6 | 19.3 | 23.3 | 20.6 | 23.2 | 23.9 | 21 | 21.8 |

TABLE 1-continued

| Protein identifier or accession number | MAD1 | MAD2 | MAD3 | MAD4 | MAD5 | MAD6 | MAD7 | MAD8 | MAD10 | MAD11 | MAD12 |
|---|---|---|---|---|---|---|---|---|---|---|---|
| gi\|1083410735\|gb\|OGF20863.1\| | 5 | 21.7 | 23.3 | 25.5 | 23 | 25 | 22.7 | 25.9 | 27.2 | 22.4 | 21.5 |
| gi\|1011480927\|ref\|WP_062376669.1\| | 4.7 | 20.1 | 20.1 | 21.4 | 19.3 | 23.3 | 21.4 | 22 | 20.2 | 19.7 | 20.9 |
| gi\|818539593\|gb\|KKR91555.1\| | 5.1 | 19.8 | 21.6 | 22.1 | 20.5 | 22.9 | 21.2 | 22.8 | 24 | 20.5 | 19.9 |
| gi\|503048015\|ref\|WP_013282991.1\| | 5.1 | 18.8 | 20.7 | 15.3 | 19.7 | 18.9 | 19.3 | 17.7 | 15.9 | 19 | 19.2 |
| gi\|1096232746\|ref\|WP_071177645.1\| | 5 | 19.1 | 20.5 | 17.4 | 20.1 | 19.7 | 20.4 | 20.4 | 17.5 | 18.5 | 18.9 |
| gi\|769130404\|ref\|WP_044910712.1\| | 4.6 | 19.4 | 18.2 | 16.1 | 18.1 | 17.1 | 18.7 | 17.9 | 14.5 | 16.8 | 17.5 |
| gi\|1085569500\|gb\|OGX23684.1\| | 2.6 | 11.6 | 12.1 | 12.7 | 10.2 | 12.1 | 12.7 | 11.6 | 10.9 | 11.1 | 10.5 |
| gi\|818357062\|gb\|KKQ38176.1\| | 3.3 | 10 | 11.1 | 10.6 | 11.1 | 11.8 | 12.1 | 11.5 | 12.2 | 10.8 | 9.8 |
| gi\|745626763\|gb\|KIE18642.1\| | 3.7 | 9.4 | 11.7 | 11.1 | 11.1 | 12.5 | 11.9 | 11.9 | 10.2 | 10.6 | 8.8 |
| MAD1 | 100 | 6.1 | 5.8 | 6.7 | 5.1 | 7.5 | 5.9 | 7.6 | 5.6 | 6.4 | 6.4 |
| SpCas9 | 4 | 6.3 | 6.5 | 8.3 | 5.6 | 8.1 | 6.9 | 7.7 | 6.9 | 6.3 | 6.3 |
| MAD12 | 6.4 | 32.6 | 33.1 | 29.7 | 29 | 31 | 30.5 | 31.7 | 26.6 | 27.8 | 100 |

Example 2: Expression of MAD Nucleases

Wild-type nucleic acid sequences for MAD1-MAD20 include SEQ ID NOs 21-40, respectively. These MAD nucleases were codon optimized for expression in *E. coli* and the codon optimized sequences are listed as SEQ ID NO: 41-60, respectively (summarized in Table 2).

Codon optimized MAD1-MAD20 were cloned into an expression construct comprising a constitutive or inducible promoter (eg., proB promoter SEQ ID NO: 83, or pBAD promoter SEQ ID NO: 81 or SEQ ID NO: 82) and an optional 6X-His tag (SEQ ID NO: 182) (eg., FIG. 2). The generated MAD1-MAD20 expression constructs are provided as SEQ ID NOs: 61-80, respectively. The expression constructs as depicted in FIG. 2 were generated either by restriction/ligation-based cloning or homology-based cloning.

Example 3. Testing Guide Nucleic Acid Sequences Compatible with MAD Nucleases

In order to have a functioning targetable nuclease complex, a nucleic acid-guided nuclease and a compatible guide nucleic acid is needed. To determine the compatible guide nucleic acid sequence, specifically the scaffold sequence portion of the guide nucleic acid, multiple approaches were taken. First, scaffold sequences were looked for near the endogenous loci of each MAD nuclease. In some cases, such as with MAD2, no endogenous scaffold sequence was found. Therefore, we tested the compatibility of MAD2 with scaffold sequences found near the endogenous loci of the other MAD nucleases. A list of the MAD nucleases and corresponding endogenous scaffold sequences that were tested is listed in Table 2.

TABLE 2

| MAD nuclease | WT nucleic acid sequence | Codon optimized nucleic acid sequence | Amino acid sequence | Endogenous scaffold sequence for guide nucleic acid |
|---|---|---|---|---|
| MAD1 | SEQ ID NO: 21 | SEQ ID NO: 41 | SEQ ID NO: 1 | SEQ ID NO: 84 |
| MAD2 | SEQ ID NO: 22 | SEQ ID NO: 42 | SEQ ID NO: 2 | None identified |
| MAD3 | SEQ ID NO: 23 | SEQ ID NO: 43 | SEQ ID NO: 3 | SEQ ID NO: 86 |
| MAD4 | SEQ ID NO: 24 | SEQ ID NO: 44 | SEQ ID NO: 4 | SEQ ID NO: 87 |
| MAD5 | SEQ ID NO: 25 | SEQ ID NO: 45 | SEQ ID NO: 5 | SEQ ID NO: 88 |
| MAD6 | SEQ ID NO: 26 | SEQ ID NO: 46 | SEQ ID NO: 6 | SEQ ID NO: 89 |
| MAD7 | SEQ ID NO: 27 | SEQ ID NO: 47 | SEQ ID NO: 7 | SEQ ID NO: 90 |
| MAD8 | SEQ ID NO: 28 | SEQ ID NO: 48 | SEQ ID NO: 8 | SEQ ID NO: 91 |
| MAD9 | SEQ ID NO: 29 | SEQ ID NO: 49 | SEQ ID NO: 9 | SEQ ID NO: 92; SEQ ID NO: 103; SEQ ID NO: 106 |
| MAD10 | SEQ ID NO: 30 | SEQ ID NO: 50 | SEQ ID NO: 10 | SEQ ID NO: 93 |
| MAD11 | SEQ ID NO: 31 | SEQ ID NO: 51 | SEQ ID NO: 11 | SEQ ID NO: 94 |
| MAD12 | SEQ ID NO: 32 | SEQ ID NO: 52 | SEQ ID NO: 12 | SEQ ID NO: 95 |
| MAD13 | SEQ ID NO: 33 | SEQ ID NO: 53 | SEQ ID NO: 13 | SEQ ID NO: 96; SEQ ID NO: 105; SEQ ID NO: 107 |
| MAD14 | SEQ ID NO: 34 | SEQ ID NO: 54 | SEQ ID NO: 14 | SEQ ID NO: 97 |
| MAD15 | SEQ ID NO: 35 | SEQ ID NO: 55 | SEQ ID NO: 15 | SEQ ID NO: 98 |
| MAD16 | SEQ ID NO: 36 | SEQ ID NO: 56 | SEQ ID NO: 16 | SEQ ID NO: 99 |
| MAD17 | SEQ ID NO: 37 | SEQ ID NO: 57 | SEQ ID NO: 17 | SEQ ID NO: 100 |
| MAD18 | SEQ ID NO: 38 | SEQ ID NO: 58 | SEQ ID NO: 18 | SEQ ID NO: 101 |
| MAD19 | SEQ ID NO: 39 | SEQ ID NO: 59 | SEQ ID NO: 19 | SEQ ID NO: 102 |
| MAD20 | SEQ ID NO: 40 | SEQ ID NO: 60 | SEQ ID NO: 20 | SEQ ID NO: 103 |

Editing cassettes as depicted in FIG. 3 were generated to assess the functionality of the MAD nucleases and corresponding guide nucleic acids. Each editing cassette comprises an editing sequence and a promoter operably linked to an encoded guide nucleic acid. The editing cassettes further comprises primer sites (P1 and P2) on flanking ends. The guide nucleic acids comprised various scaffold sequences to be tested, as well as a guide sequence to guide the MAD nuclease to the target sequence for editing. The editing sequences comprised a PAM mutation and/or codon mutation relative to the target sequence. The mutations were flanked by regions of homology (homology arms or HA) which would allow recombination into the cleaved target sequence.

Figure 4:
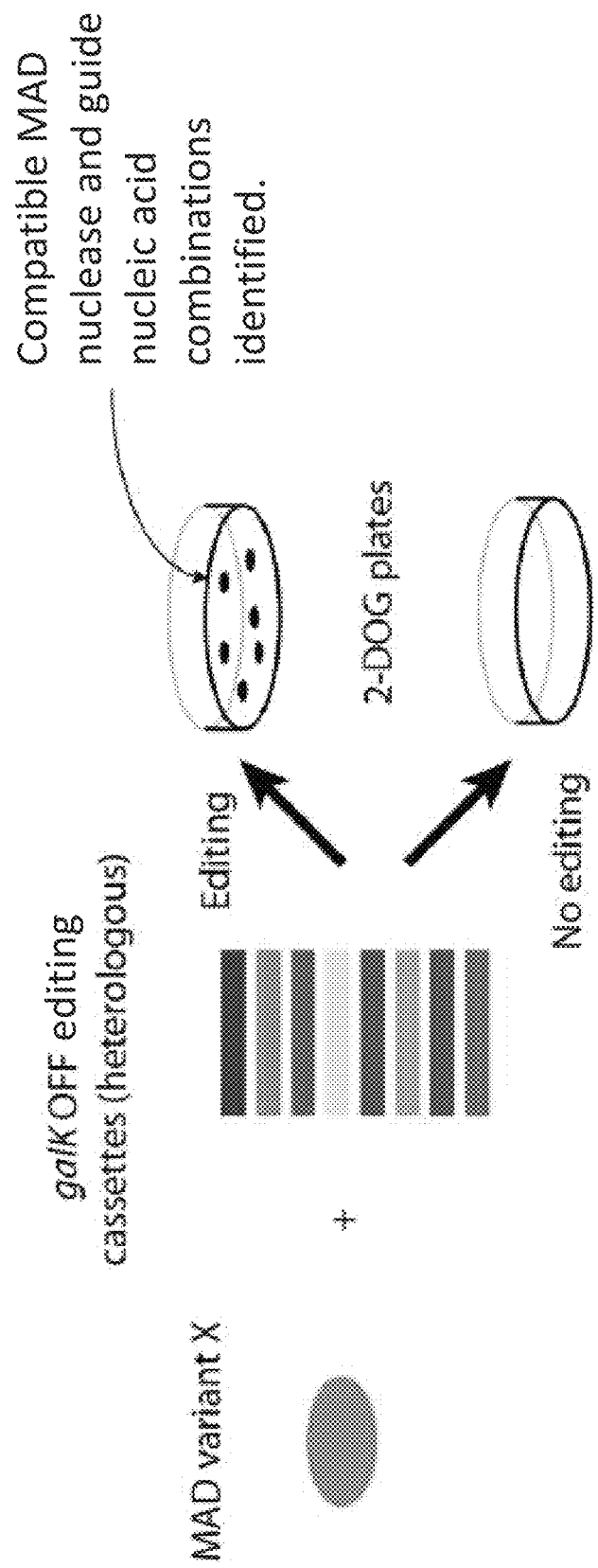
FIG. 4 depicts an example screening or selection experiment workflow.
Figure 14A:
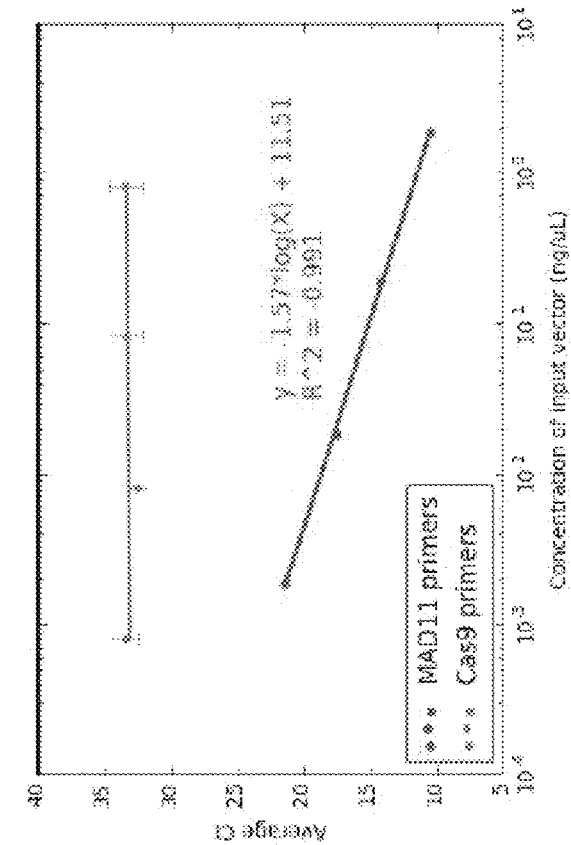
FIG. 14A-14B depict example data from a primer validation experiment.
Figure 14B:
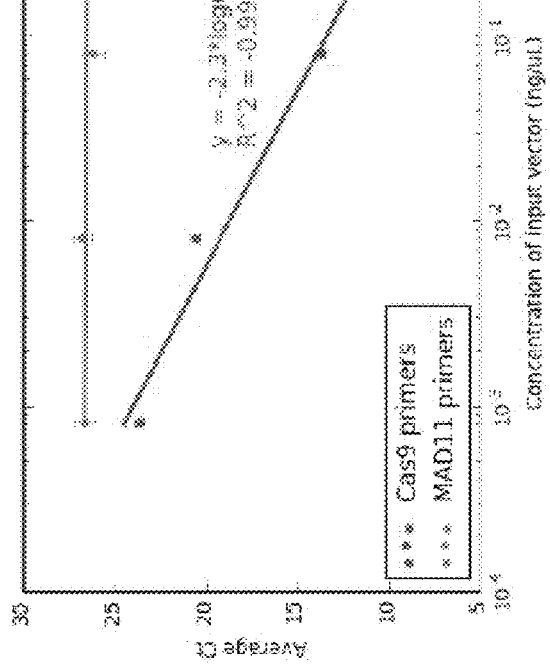

FIG. 4 depicts an experimental designed to test different MAD nuclease and guide nucleic acid combinations. An expression cassette encoding the MAD nuclease or the MAD nuclease protein were added to host cells along with various editing cassettes as described above. In this example, the guide nucleic acids were engineered to target the galK gene in the host cell, and the editing sequence was designed to mutate the targeted galK gene in order to turn the gene off, thereby allowing for screening of successfully edited cells. This design was used for identification of functional or compatible MAD nuclease and guide nucleic acid combinations. Editing efficiency was determined by qPCR to measure the editing plasmid in the recovered cells in a high-throughput manner. Validation of MAD11 and Cas9 primers is shown in FIGS. 14A and 14B. These results show that the selected primer pairs are orthogonal and allow quantitative measurement of input plasmid DNA FIGS. 5A-5B is a depiction of a similar experimental design. In this case, the editing cassette (FIG. 5B) further comprises a selectable marker, in this case kanamycin resistance (kan) and the MAD nuclease expression vector (FIG. 5A) further comprises a selectable marker, in this case chloramphenicol resistance (Cm), and the lambda RED recombination system to aid homologous recombination (HR) of the editing sequence into the target sequence. A compatible MAD nuclease and guide nucleic acid combination will cause a double strand break in the target sequence if a PAM sequence is present. Since the editing sequence (eg. FIG. 3) contains a PAM mutation that is not recognized by the MAD nuclease, edited cells that contain the PAM mutation survive cleavage by the MAD nuclease, while wild-type non-edited cells die (FIG. 5C). The editing sequence further comprises a mutation in the galK gene that allows for screening of edited cells, while the MAD nuclease expression vector and editing cassette contain drug selection markers, allowing for selection of edited cells.

Using these methods, compatible guide nucleic acids for MAD1-MAD20 were tested. Twenty scaffold sequences were tested. The guide nucleic acids used in the experiments contained one of the twenty scaffold sequences, referred to as scaffold-1, scaffold-2, etc., and a guide sequence that targets the galK gene. Sequences for Scaffold-1 through Scaffold-20 are listed as SEQ ID NO: 84-103, respectively. It should be understood that the guide sequence of the guide nucleic acid is variable and can be engineered or designed to target any desired target sequence. Since MAD2 does not have an endogenous scaffold sequence to test, a scaffold sequence from a close homology (scaffold-2, SEQ ID NO: 85) was tested and found to be a non-functional pair, meaning MAD2 and scaffold-2 were not compatible. Therefore, MAD2 was tested with the other nineteen scaffold sequences, despite the low sequence homology between MAD2 and the other MAD nucleases.

This workflow could also be used to identify or test PAM sequences compatible with a given MAD nuclease. Another method for identifying a PAM site is described in the next example.

In general, for the assays described, transformations were carried out as follows. E. coli strains expressing the codon optimized MAD nucleases were grown overnight. Saturated cultures were diluted 1/100 and grown to an OD600 of 0.6 and induced by adding arabinose at a filing concentration of 0.4% and (if a temperature sensitive plasmid is used) shifting the culture to 42 degrees Celsius in a shaking water bath. Following induction, cells were chilled on ice for 15 min prior to washing thrice with ¼ the initial culture volume with 10% glycerol (for example, 50 mL washed for a 200 mL culture). Cells were resuspended in 1/100 the initial volume (for example, 2 mL for a 200 mL culture) and stores at −90 degrees Celsius until ready to use. To perform the compatibility and editing efficiency screens described here, 50 ng of editing cassette was transformed into cell aliquots by electroporation. Following electroporation, the cells were recovered in LB for 3 hours and 100 μL of cells were plated on Macconkey plates containing 1% galactose.

Editing efficiencies were determined by dividing the number of white colonies (edited cells) by the total number of white and red colonies (edited and non-edited cells).

Example 4. PAM Selection Assay

In order to generate a double strand break in a target sequence, a guide nucleic acid must hybridize to a target sequence, and the MAD nuclease must recognize a PAM sequence adjacent to the target sequence. If the guide nucleic acid hybridizes to the target sequence, but the MAD nuclease does not recognize a PAM site, then cleavage does not occur.

A PAM is MAD nuclease-specific and not all MAD nucleases necessarily recognize the same PAM. In order to assess the PAM site requirements for the MAD nucleases, an assay as depicted in FIGS. 6A-6C was performed.

FIG. 6A depicts a MAD nuclease expression vector as described elsewhere, which also contains a chloramphenicol resistance gene and the lambda RED recombination system.

FIG. 6B depicts a self-targeting editing cassette. The guided nucleic acid is designed to target the target sequence which is contained on the same nucleic acid molecule. The target sequence is flanked by random nucleotides, depicted by N4, meaning four random nucleotides on either end of the target sequence. It should be understood that any number of random nucleotides could also be used (for example, 3, 5, 6, 7, 8, etc). The random nucleotides serve as a library of potential PAMs.

FIG. 6C depicts the experimental design. Basically, the MAD nuclease expression vector and editing cassette comprising the random PAM sites were transformed into a host cell. If a functional targetable nuclease complex was formed and the MAD nuclease recognized a PAM site, then the editing cassette vector was cleaved and which leads to cell death. If a functional targetable complex was not formed or if the MAD nuclease did not recognize the PAM, then the target sequence was not cleaved and the cell survived. Next generation sequence (NGS) was then used to sequence the starting and final cell populations in order to determine what PAM sites were recognized by a given MAD nuclease. These recognized PAM sites were then used to determine a consensus or non-consensus PAM for a given MAD nuclease.

The consensus PAM for MAD1-MAD8, and MAD10-MAD12 was determined to be TTTN. The consensus PAM for MAD9 was determined to be NNG. The consensus PAM for MAD13-MAD15 was determined to be TTN. The consensus PAM for MAD16-MAD18 was determined to be TA. The consensus PAM for MAD19-MAD20 was determined to be TTCN.

Example 5: Testing Heterologous Guide Nucleic Acids

Editing efficiencies were tested for MAD1, MAD2, MAD4, and MAD7 and are depicted in FIG. 7A and FIG. 7B. Experiment details and editing efficiencies are summarized in Table 3. Editing efficiency was determined by dividing the number of edited cells by the total number of recovered cells. Various editing cassettes targeting the galK gene were used to allow screening of editing cells. The guide nucleic acids encoded on the editing cassette contained a guide sequence targeting the galK gene and one of various scaffold sequences in order to test the compatibility of the indicated MAD nuclease with the indicated scaffold sequence, as summarized in Table 3.

Editing efficiencies for compatible MAD nuclease and guide nucleic acids (comprising the indicated scaffold sequences) were observed to have between 75-100% editing efficiency. MAD2 had between a 75-100% editing efficiency and MAD7 had between a 97-100% editing efficiency.

MAD2 combined with scaffold-1, scaffold-2, scaffold-4, or scaffold-13 in these experiments results in 0% editing efficiency. These data imply that MAD2 did not form a functional complex with these tested guide nucleic acids and that MAD2 is not compatible with these scaffold sequences.

MAD7 combined with scaffold-1, scaffold-2, scaffold-4, or scaffold-13 in these experiments results in 0% editing efficiency. These data imply that MAD7 did not form a functional complex with these tested guide nucleic acids and that MAD7 is not compatible with these scaffold sequences.

For MAD1 and MAD4, all tested guide nucleic acid combinations resulted in 0% editing efficiency, implying that MAD1 and MAD4 did not form a functional complex with any of the tested guide nucleic acids. These data also imply that MAD1 and MAD4 are not compatible with the tested scaffold sequences.

Combined, these data highlight the unpredictability of finding a compatible MAD nuclease and scaffold sequence pair in order to form a functional targetable nuclease complex. Some tested MAD nucleases did not function with any tested scaffold sequence. Some tested MAD nucleases only functioned with some tested scaffold sequences and not with others.

TABLE 3

| # | Nucleic acid-guided nuclease | Guide nucleic acid scaffold sequence | Editing sequence mutation | Target gene | Editing efficiency |
|---|---|---|---|---|---|
| 1 | MAD1 | Scaffold-1; SEQ ID NO: 84 | L80** | galK | 0% |
| 2 | MAD1 | Scaffold-2; SEQ ID NO: 85 | Y145** | galK | 0% |
| 3 | MAD1 | Scaffold-4; SEQ ID NO: 87 | Y145** | galK | 0% |
| 4 | MAD1 | Scaffold-10; SEQ ID NO: 93 | Y145** | galK | 0% |
| 5 | MAD1 | Scaffold-11; SEQ ID NO: 94 | L80** | galK | 0% |
| 6 | MAD1 | Scaffold-12; SEQ ID NO: 95 | L10KpnI | galK | 0% |
| 7 | MAD1 | Scaffold-13; SEQ ID NO: 96 | Y145** | galK | 0% |
| 8 | MAD1 | Scaffold-12; SEQ ID NO: 95 | L10KpnI | galK | 0% |
| 9 | MAD2 | Scaffold-10; SEQ ID NO: 93 | L80** | galK | 0% |
| 10 | MAD2 | Scaffold-10; SEQ ID NO: 93 | Y145** | galK | 100% |
| 11 | MAD2 | Scaffold-11; SEQ ID NO: 94 | L80** | galK | 98% |
| 12 | MAD2 | Scaffold-11; SEQ ID NO: 94 | Y145** | galK | 99% |
| 13 | MAD2 | Scaffold-12; SEQ ID NO: 95 | Y145** | galK | 98% |
| 14 | MAD2 | Scaffold-12; SEQ ID NO: 95 | Y145** | galK | 0% |
| 15 | MAD2 | Scaffold-13; SEQ ID NO: 96 | Y145** | galK | 0% |
| 16 | MAD2 | Scaffold-1; SEQ ID NO: 84 | L80** | galK | 0% |
| 17 | MAD2 | Scaffold-2; SEQ ID NO: 85 | Y145** | galK | 0% |
| 18 | MAD2 | Scaffold-2; SEQ ID NO: 85 | Y145** | galK | 0% |
| 19 | MAD2 | Scaffold-4; SEQ ID NO: 87 | Y145** | galK | 0% |
| 20 | MAD2 | Scaffold-5; SEQ ID NO: 88 | L80** | galK | 99% |
| 21 | MAD2 | Scaffold-12; SEQ ID NO: 95 | 89** | galK | 0% |
| 22 | MAD2 | Scaffold-12; SEQ ID NO: 95 | 70** | galK | 75% |
| 23 | MAD2 | Scaffold-12; SEQ ID NO: 95 | L10KpnI | galK | 79% |
| 24 | MAD4 | Scaffold-1; SEQ ID NO: 84 | L80** | galK | 0% |
| 25 | MAD4 | Scaffold-2; SEQ ID NO: 85 | Y145** | galK | 0% |
| 26 | MAD4 | Scaffold-4; SEQ ID NO: 87 | Y145** | galK | 0% |
| 27 | MAD4 | Scaffold-10; SEQ ID NO: 93 | Y145** | galK | 0% |
| 28 | MAD4 | Scaffold-11; SEQ ID NO: 94 | L80** | galK | 0% |
| 29 | MAD4 | Scaffold-12; SEQ ID NO: 95 | L10KpnI | galK | 0% |
| 30 | MAD4 | Scaffold-13; SEQ ID NO: 96 | Y145** | galK | 0% |
| 31 | MAD4 | Scaffold-12; SEQ ID NO: 95 | L10KpnI | galK | 0% |
| 32 | MAD7 | Scaffold-1; SEQ ID NO: 84 | L80** | galK | 0% |
| 33 | MAD7 | Scaffold-2; SEQ ID NO: 85 | Y145** | galK | 0% |
| 34 | MAD7 | Scaffold-4; SEQ ID NO: 87 | Y145** | galK | 0% |
| 35 | MAD7 | Scaffold-10; SEQ ID NO: 93 | Y145** | galK | 100% |
| 36 | MAD7 | Scaffold-11; SEQ ID NO: 94 | L80** | galK | 97% |
| 37 | MAD7 | Scaffold-12; SEQ ID NO: 95 | L10KpnI | galK | 0% |
| 38 | MAD7 | Scaffold-13; SEQ ID NO: 96 | Y145** | galK | 0% |
| 39 | MAD7 | Scaffold-12; SEQ ID NO: 95 | L10KpnI | galK | 0% |

Example 6. Assessment of MAD2 and MAD7

The ability of MAD2 and MAD7 to function with heterologous guide nucleic acids were tested using a similar experimental design as described above.

Figure 8:
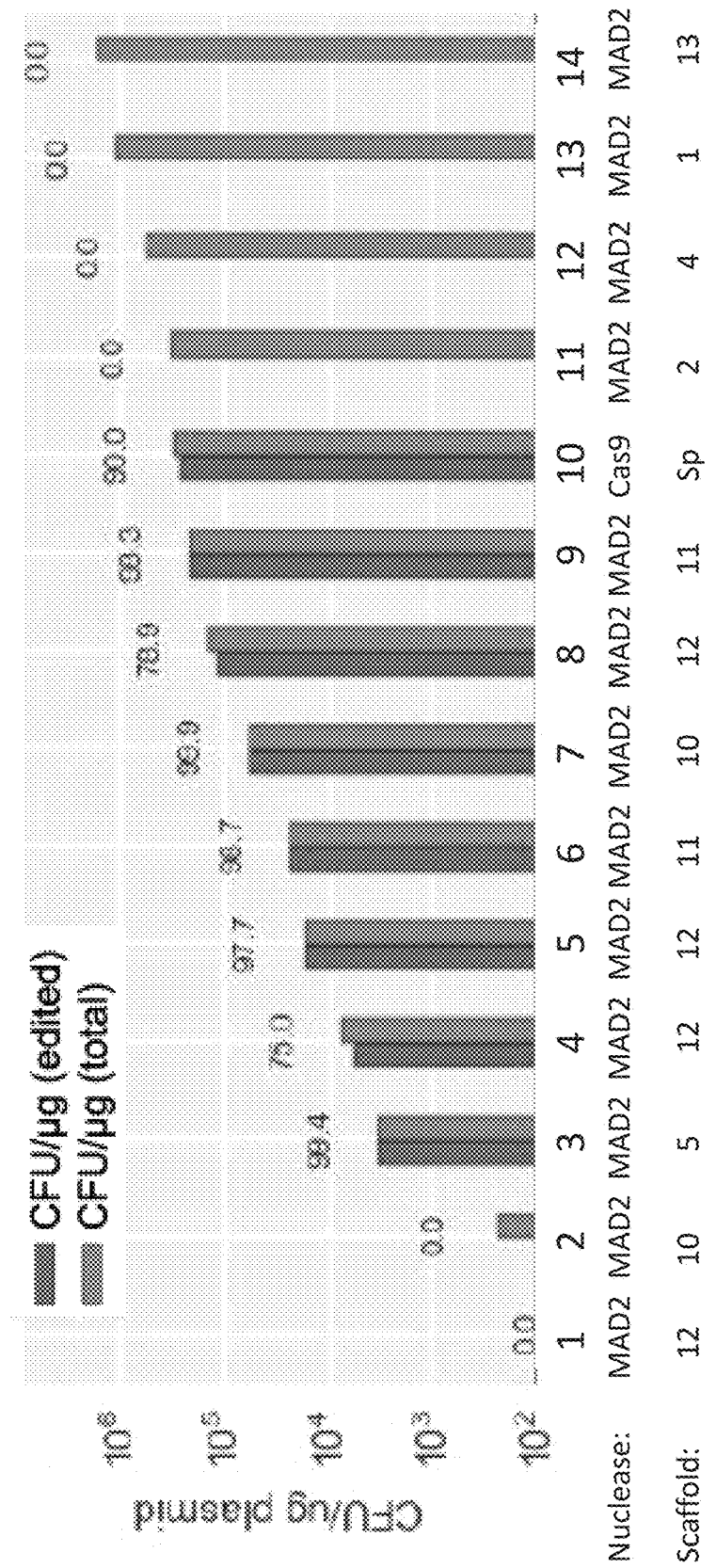
FIG. 8 depicts example data from a targetable nuclease complex-based editing experiment.

The compatibility of MAD2 with other scaffold sequences was tested and the results of an experiment are depicted in FIG. 8. The MAD nucleases, guide nucleic acid scaffold sequences, and editing sequences used in this experiment are summarized in Table 4.

Figure 9:
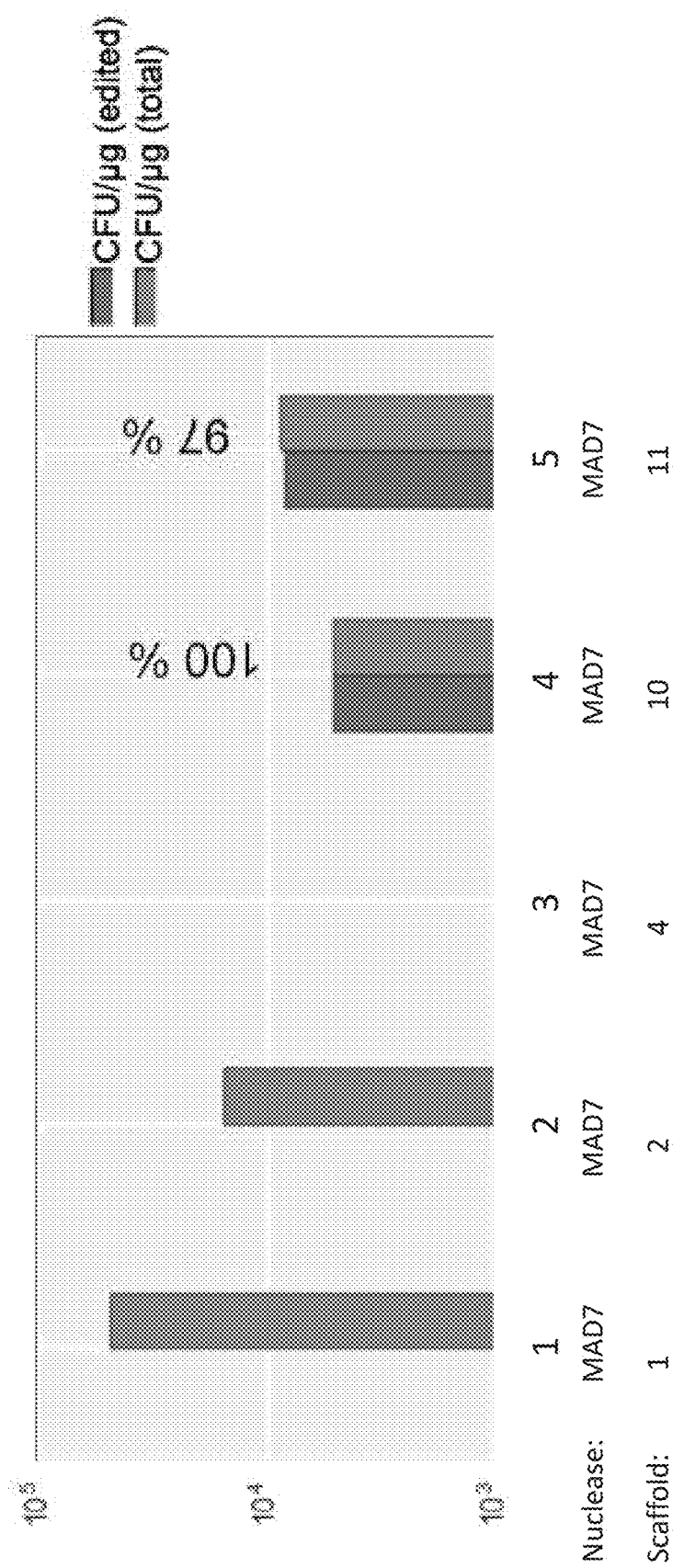
FIG. 9 depicts example data from a targetable nuclease complex-based editing experiment.

The compatibility of MAD7 with other scaffold sequences was tested and the results of an experiment are depicted in FIG. 9. The MAD nucleases, guide nucleic acid scaffold sequences, and editing sequences used in this experiment are summarized in Table 5.

TABLE 4

| # | Nucleic acid-guided nuclease | Guide nucleic acid scaffold sequence | Editing sequence mutation | Target gene |
|---|---|---|---|---|
| 1 | MAD2 | Scaffold-12; SEQ ID NO: 95 | N89KpnI | galK |
| 2 | MAD2 | Scaffold-10; SEQ ID NO: 93 | L80** | galK |
| 3 | MAD2 | Scaffold-5; SEQ ID NO: 88 | L80** | galK |
| 4 | MAD2 | Scaffold-12; SEQ ID NO: 95 | D70KpnI | galK |
| 5 | MAD2 | Scaffold-12; SEQ ID NO: 95 | Y145** | galK |
| 6 | MAD2 | Scaffold-11; SEQ ID NO: 94 | Y145** | galK |
| 7 | MAD2 | Scaffold-10; SEQ ID NO: 93 | Y145** | galK |
| 8 | MAD2 | Scaffold-12; SEQ ID NO: 95 | L10KpnI | galK |
| 9 | MAD2 | Scaffold-11; SEQ ID NO: 94 | L80** | galK |
| 10 | SpCas9 | S. pyogenese gRNA | Y145** | galK |
| 11 | MAD2 | Scaffold-2; SEQ ID NO: 85 | Y145** | galK |
| 12 | MAD2 | Scaffold-4; SEQ ID NO: 87 | Y145** | galK |
| 13 | MAD2 | Scaffold-1; SEQ ID NO: 84 | L80** | galK |
| 14 | MAD2 | Scaffold-13; SEQ ID NO: 96 | Y145** | galK |

TABLE 5

| # | Nucleic acid-guided nuclease | Guide nucleic acid scaffold sequence | Editing sequence mutation | Target gene |
|---|---|---|---|---|
| 1 | MAD7 | Scaffold-1; SEQ ID NO: 84 | L80** | galK |
| 2 | MAD7 | Scaffold-2; SEQ ID NO: 85 | Y145** | galK |
| 3 | MAD7 | Scaffold-4; SEQ ID NO: 87 | Y145** | galK |
| 4 | MAD7 | Scaffold-10; SEQ ID NO: 93 | Y145** | galK |
| 5 | MAD7 | Scaffold-11; SEQ ID NO: 95 | L80** | galK |

Figure 10A:
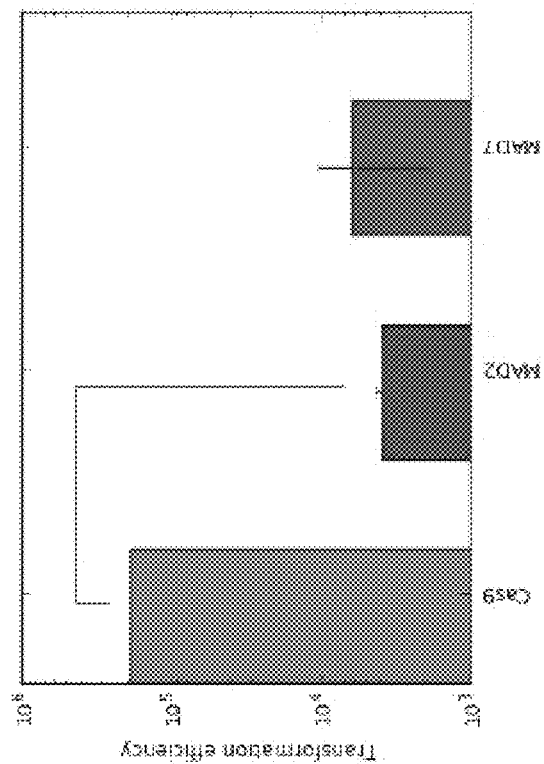
FIGS. 10A-10C depict example data from a targetable nuclease complex-based editing experiment.
Figure 10B:
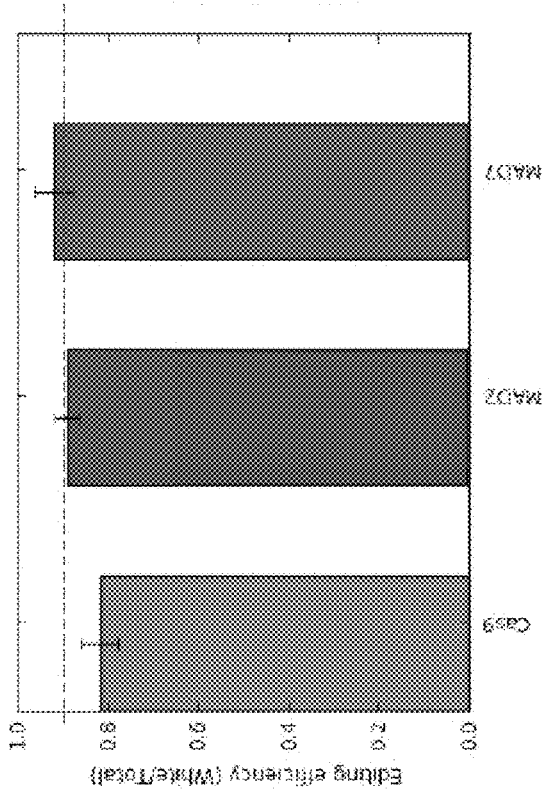
Figure 10C:
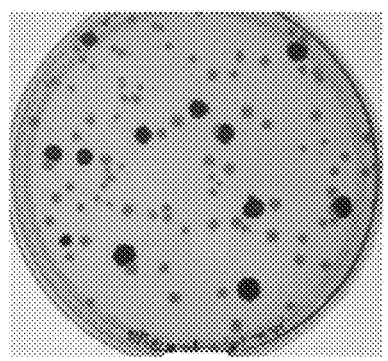

In another experiment, transformation efficiencies (FIG. 10B) were determined by calculating the total number of recovered cells compared to the start number of cells. An example plate image is depicted in FIG. 10C. Editing efficiencies (FIG. 10A) were determined by calculating the ratio of editing colonies (white colonies, edited galK gene) versus total colonies.

In this example (FIG. 10A-10C), cells expressing galK were transformed with expression constructs expressing either MAD2 or MAD7 and a corresponding editing cassette comprising a guide nucleic acid targeting the galK gene. The guide nucleic acid was comprised of a guide sequence targeting the galK gene and the scaffold-12 sequence (SEQ ID NO: 95).

In the depicted example, MAD2 and MAD7 has a lower transformation efficiency compared to S. pyogenes Cas9, though the editing efficiency of MAD2 and MAD7 was slightly higher than S. pyogenes Cas9.

Figure 11:
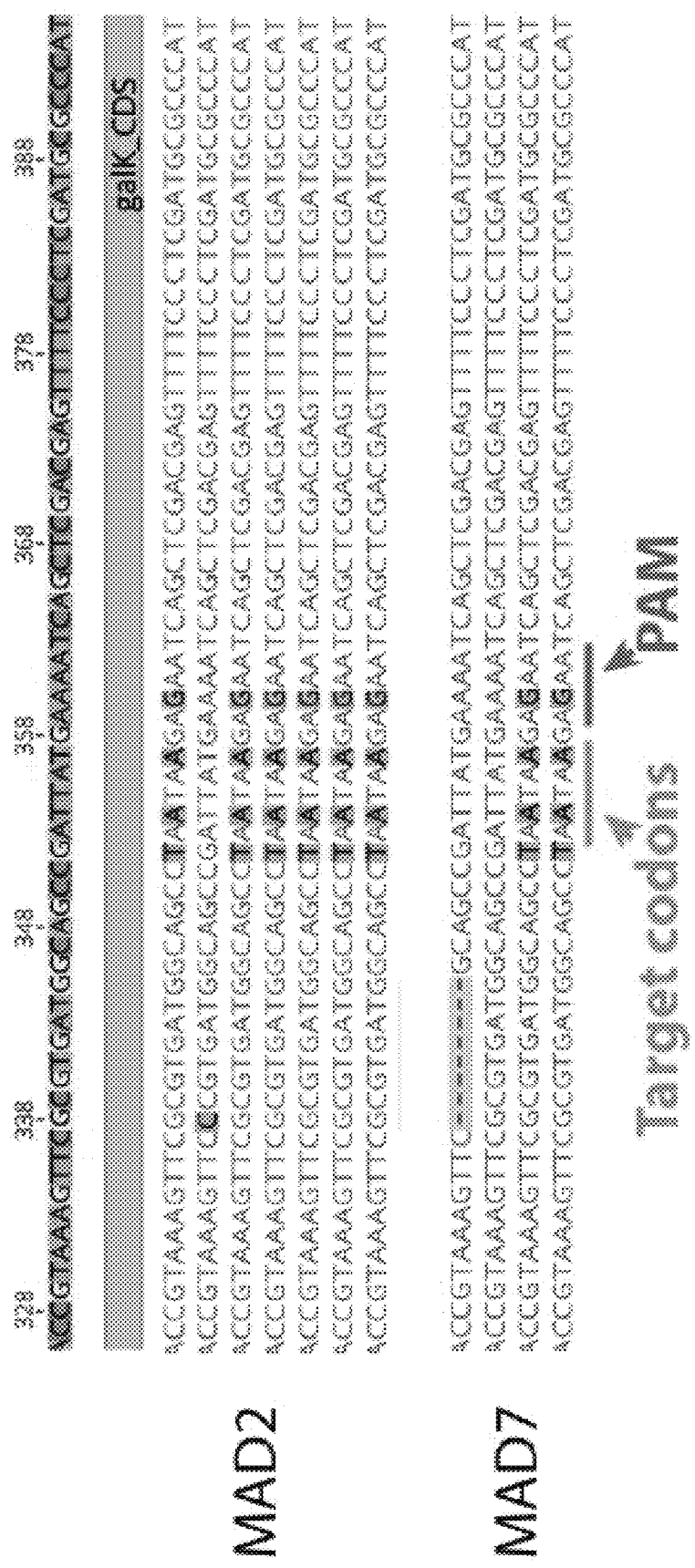
FIG. 11 depicts a example sequence alignment of select sequences from an editing experiment.

FIG. 11 depicts the sequencing results from select colonies recovered from the assay described above. The target sequence was in the galK coding sequence (CDS). The TTTN PAM is shown as the reverse complement (wild-type NAAA, mutated NGAA). The mutations targeted by the editing sequence are labeled as target codons. Changes compared to the wild-type sequence are highlighted. In these experiments, the scaffold-12 sequence (SEQ ID NO: 95) was used. The guide sequence of the guide nucleic acid targeted the galK gene.

Six of the seven depicted sequences from the MAD2 experiment contained the designed PAM mutation and designed mutations in the target codons of galK, which one sequences colony maintained the wild-type PAM and wild-type target codons while also containing an unintended mutation upstream of the target site.

Two of the four depicted sequences from the MAD7 experiment contained the designed PAM mutation and mutated target codons. One colony comprises a wildtype sequence, while another contained a deletion of eight nucleotides upstream of the target sequence.

Figure 12:
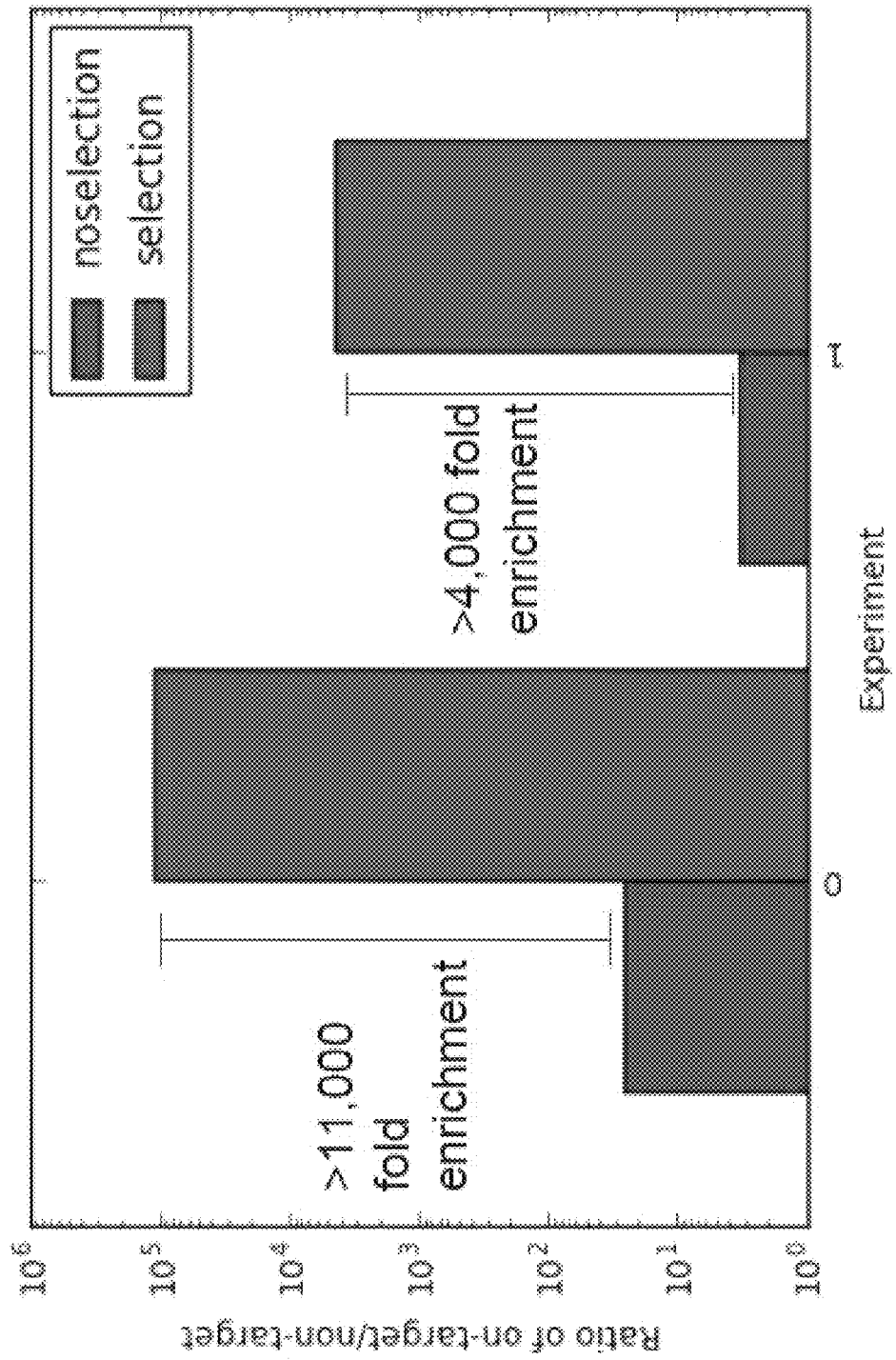
FIG. 12 depicts example data from a targetable nuclease complex-based editing experiment.

FIG. 12 depicts results from another experiment testing the ability to recover edited cells. In Experiment 0, the MAD2 nuclease was used with a guide nucleic acid comprising scaffold-11 sequence and a guide sequence targeting galK. The editing cassette comprised an editing sequence designed to incorporate an L80** mutation into galK, thereby allowing screening of the edited cells. In experiment 1, the MAD2 nuclease was used with a guide nucleic acid comprising scaffold-12 sequence and a guide sequence targeting galK. The editing cassette comprised an editing sequence designed to incorporate an L10KpnI mutation into galK. In both experiments, a negative control plasmid a guide nucleic acid that is not compatible with MAD2 was included in the transformations. Following transformation, the ratio of the compatible editing cassette (those containing scaffold-11 or scaffold-12 guide nucleic acids) to the non-compatible editing cassette (negative control) was measure. The experiments were done in the presence or absence of selection. The results show that more compatible editing cassette containing cells were recovered compared to the non-compatible editing cassette, and this result is magnified when selection is used.

Example 7. Guide Nucleic Acid Characterization

The sequences of scaffolds 1-8, and 10-12 (SEQ ID NO: 84-91, and 93-95) were aligned and are depicted in FIG. 13A. Nucleotides that match the consensus sequence are faded, while those diverging from the consensus sequence are visible. The predicted pseudoknot region is indicated. Without being bound by theory, the region 5' of the pseudoknot may be influence binding and/or kinetics of the nucleic acid-guided nuclease. As is shown in FIG. 13A, in general, there appears to be less variability in the pseudoknot region (e.g., SEQ ID NO: 172-181) as compared to the sequence outside of the pseudoknot region.

Figure 13B:
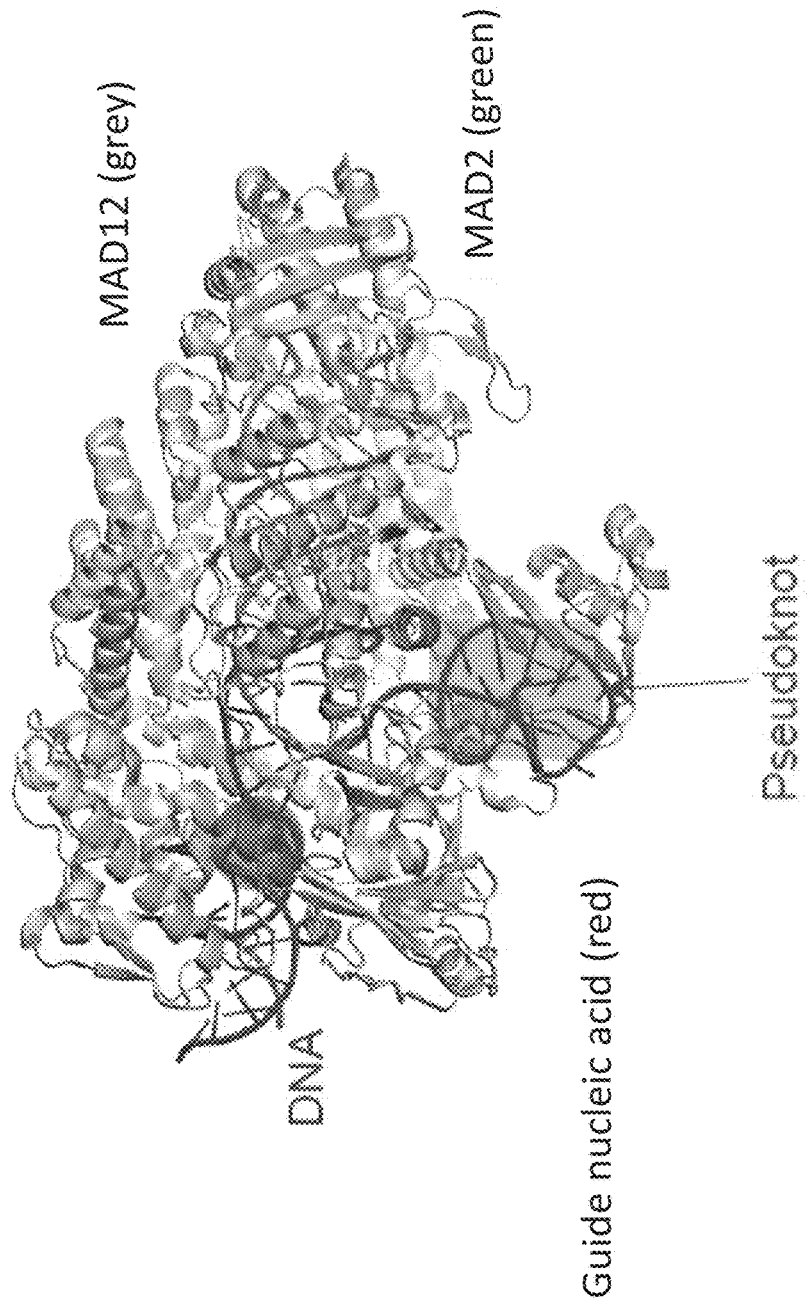
FIG. 13B depicts an example model of a nucleic acid-guided nuclease complexed with a guide nucleic acid and a target sequence.

FIG. 13B shows a preliminary model of MAD2 and MAD12 complexed with a guide nucleic acid (in this example, a guide RNA) and target sequence (DNA).

Example 8. Editing Efficiency of the MAD Nucleases

A plate-based editing efficiency assay and a molecular editing efficiency assay were used to test editing efficiency of various MAD nuclease and guide nucleic acid combinations.

Figure 15:
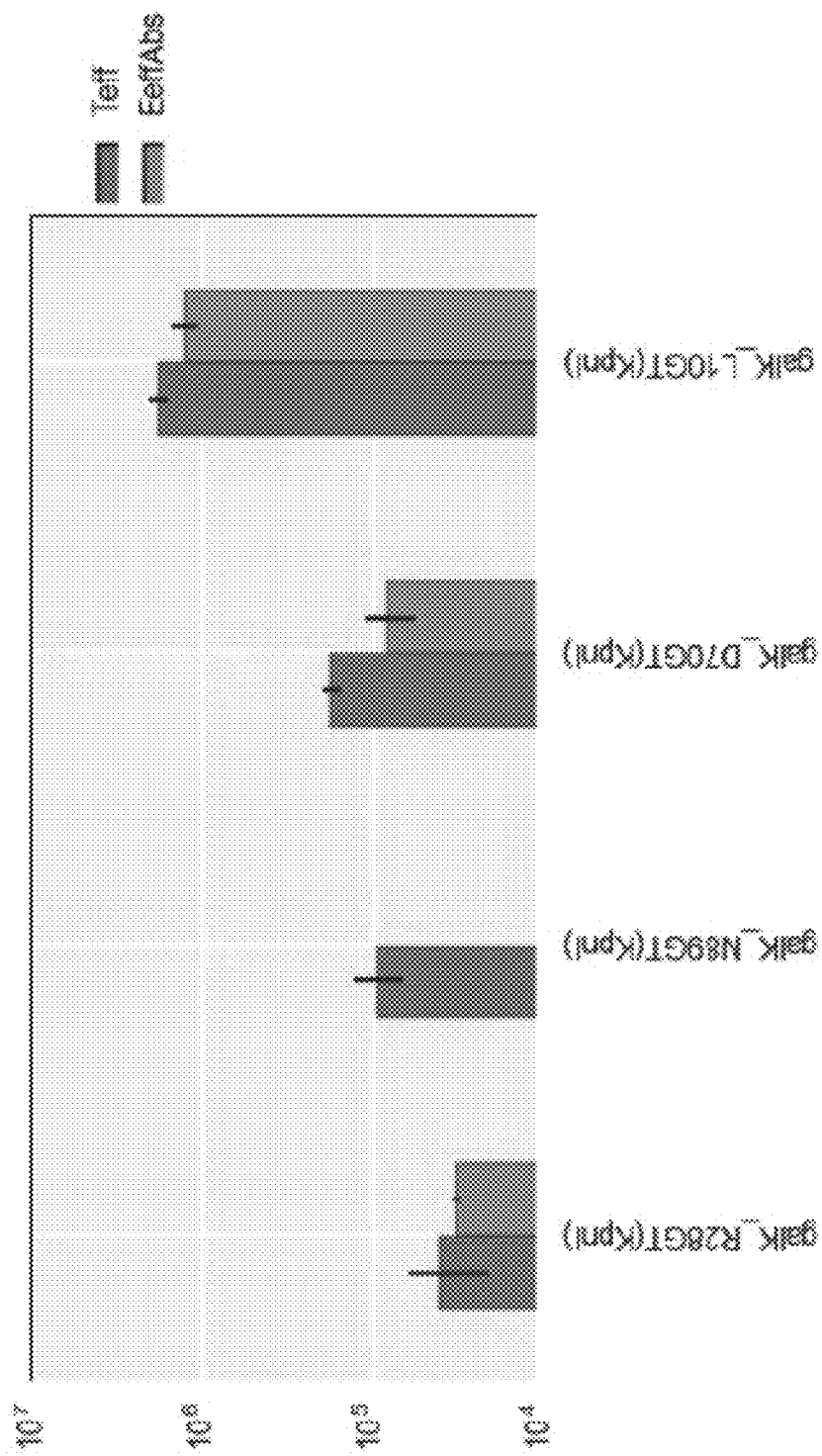
FIG. 15 depicts example data from a targetable nuclease complex-based editing experiment.
Figure 16:
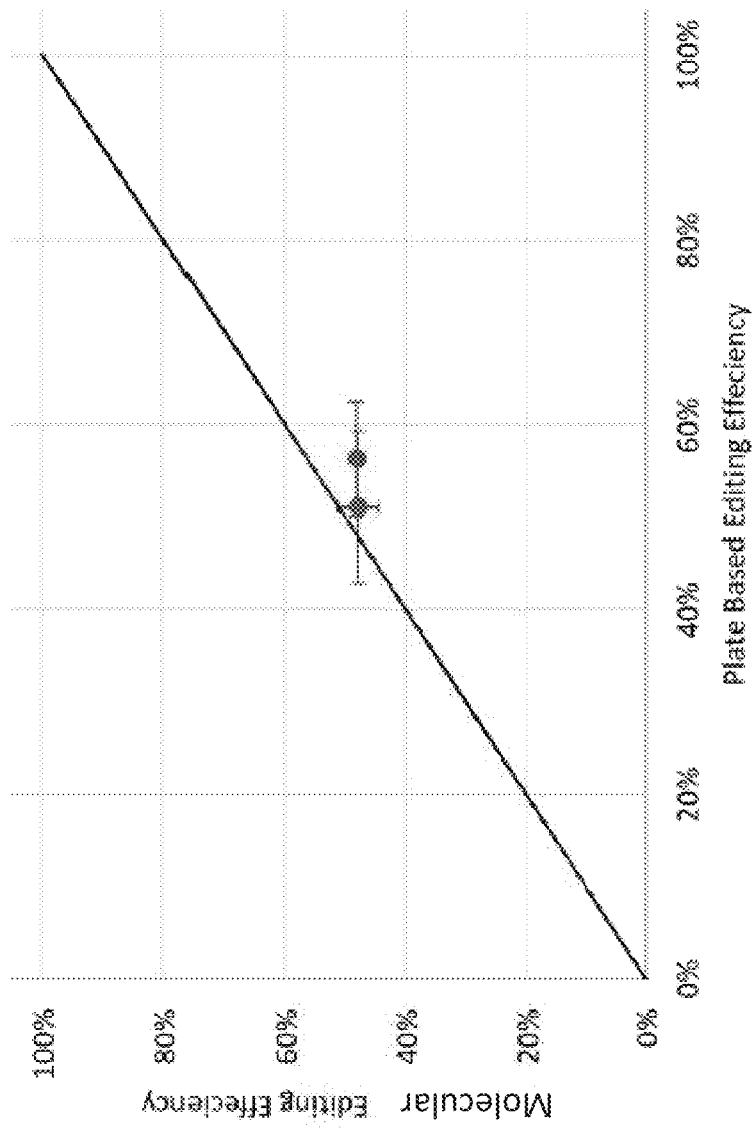
FIG. 16 depicts example validation data comparing results from two different assays.

FIG. 15 depicts quantification of the data obtained using the molecular editing efficiency assay using MAD2 nuclease with a guide nucleic acid comprising scaffold-12 and a guide sequencing targeting galK. The indicated mutations were incorporated into the galK using corresponding editing cassettes containing the mutation. FIG. 16 shows the comparison of the editing efficiencies determined by the plate-based assay using white and red colonies as described previously, and the molecular editing efficiency assay. As shown in FIG. 16, the editing efficiencies as determined by the two separate assays are consistent.

Example 9. Trackable Editing

Genetic edits can be tracked by the use of a barcode. A barcode can be incorporated into or near the edit site as described in the present specification. When multiple rounds of engineering are being performed, with a different edit being made in each round, it may be beneficial to insert a barcode in a common region during each round of engineering, this way one could sequence a single site and get the sequences of all of the barcodes from each round without the need to sequence each edited site individually. FIGS. 17A-17C, 18, and 19 depict examples of such trackable engineering workflows.

Figure 17A:
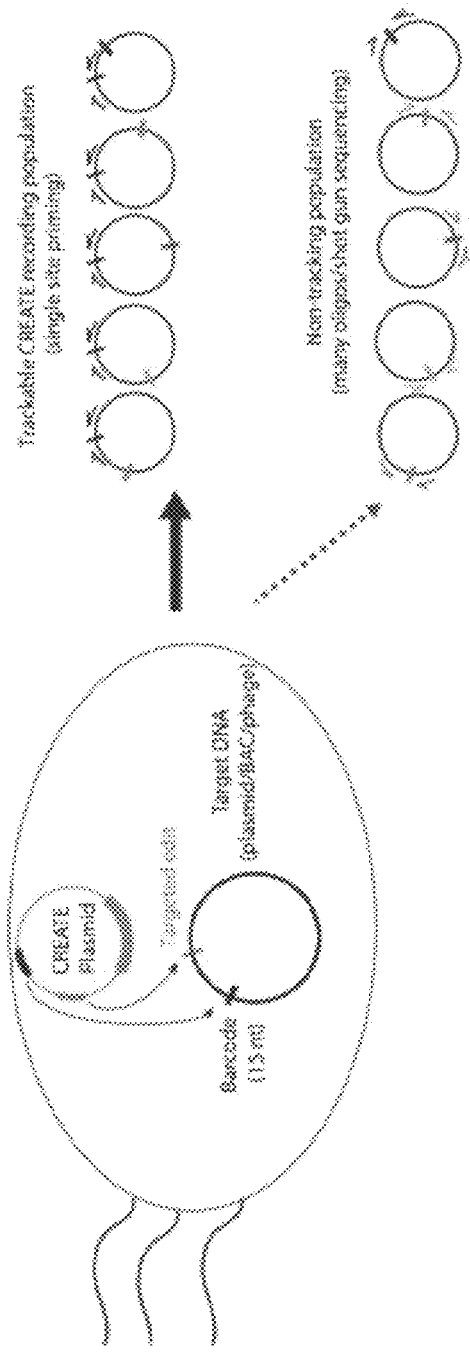
FIG. 17A-17C depict an example trackable genetic engineering workflow, including a plasmid comprising an editing cassette and a recording cassette, and downstream sequencing of barcodes in order to identify the incorporated edit or mutation.
Figure 17C:
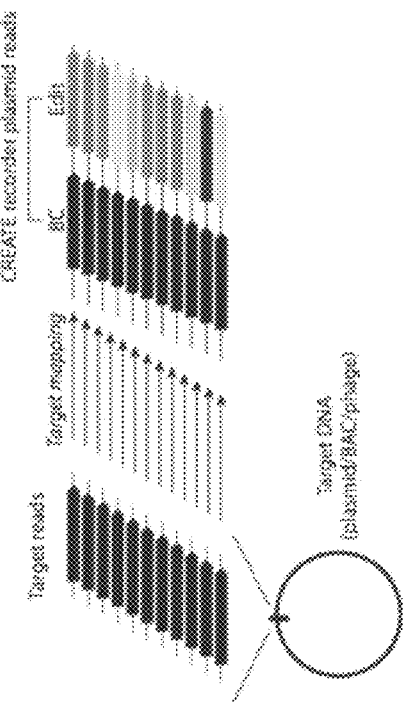
Figure 17B:
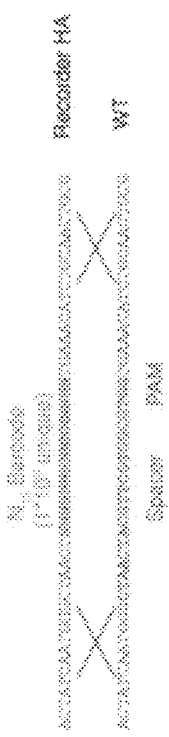

As depicted in FIG. 17A, a cell expressing a MAD nuclease is transformed with a plasmid containing an editing cassette and a recording cassette. The editing cassette contains a PAM mutation and a gene edit. The recorder cassette comprises a barcode, in this case 15N. Both the editing cassette and recording cassette each comprise a guide nucleic acid to a distinct target sequence. Within a library of such plasmids, the recorder cassette for each round can contain the same guide nucleic acid, such that the first round barcode is inserted into the same location across all variants, regardless of what editing cassette and corresponding gene edit is used. The correlation between the barcode and editing cassette is determined beforehand though such that the edit can be identified by sequencing the barcode. FIG. 17B shows an example of a recording cassette designed to delete a PAM site while incorporating a 15N barcode. The deleted PAM is used to enrich for edited cells since mutated PAM cells escape cell death while cells containing a wild-type PAM sequence are killed. Fire 21 C depicts how sequencing the barcode region can be used to identify which edit is comprised within each cell.

Figure 18:
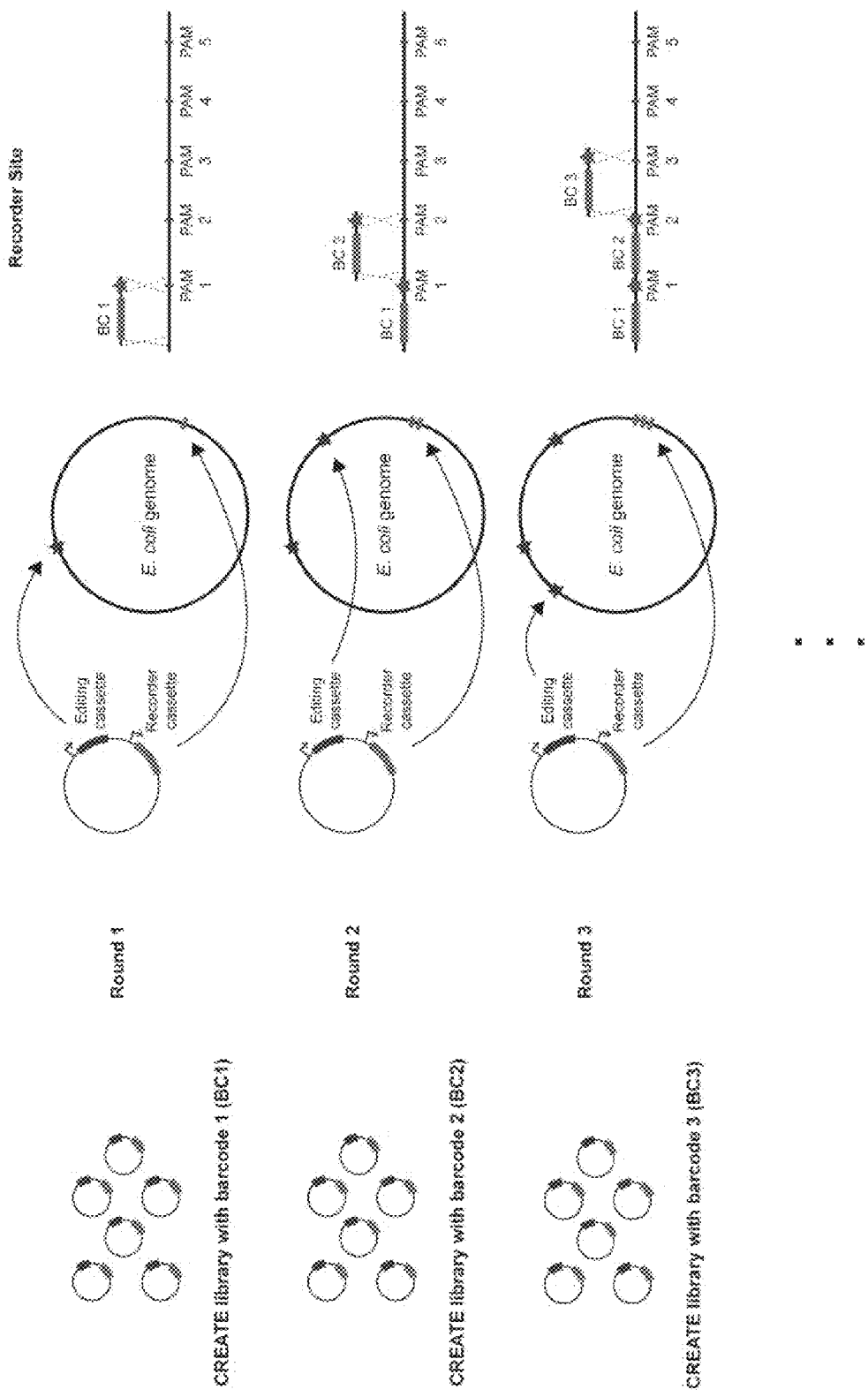
FIG. 18 depicts an example trackable genetic engineering workflow, including iterative rounds of engineering with a different editing cassette and recorder cassette with unique barcode (BC) at each round, which can be followed by selection and tracking to confirm the successful engineering step at each round.

A similar approach is depicted in FIG. 18. In this case, the recorder cassette from each round is designed to target a sequence adjacent to the previous round, and each time, a new PAM site is deleted by the recorder cassette. The result is a barcode array with the barcodes from each round that can be sequenced to confirm each round of engineering took place and to determine which combination of mutations are contained in the cell, and in which order the mutations were made. Each successive recorder cassette can be designed to be homologous on one end to the region comprising the mutated PAM from the previous round, which could increase the efficiency of getting fully edited cells at the end of the experiment. In other examples, the recorder cassette is designed to target a unique landing site that was incorporated by the previous recorder cassette. This increases the efficiency of recovering cells containing all of the desired mutations since the subsequent recorder cassette and barcode can only target a cell that has successfully completed the previous round of engineering.

Figure 19:
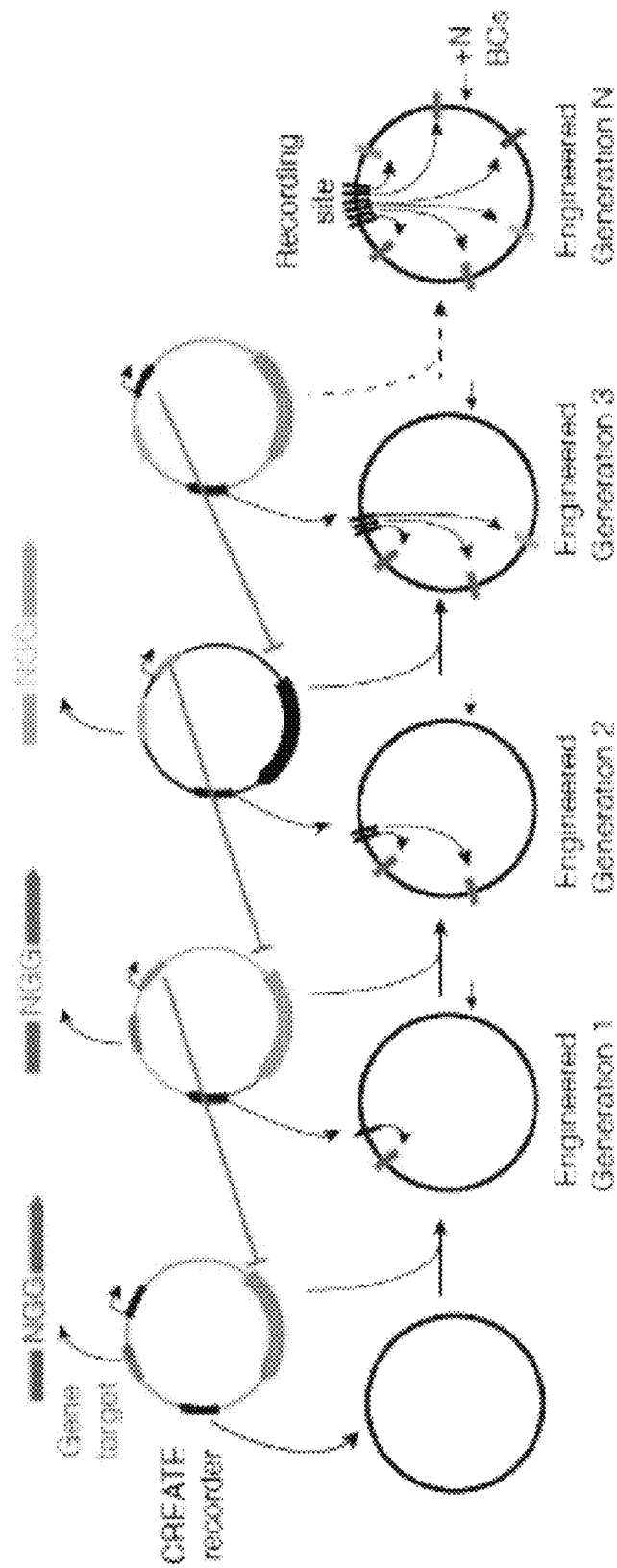
FIG. 19 depicts an example recursive engineering workflow.

FIG. 19 depicts another approach that allows the recycling of selectable markers or to otherwise cure the cell of the plasmid form the previous round of engineering. In this case, the transformed plasmid containing a guide nucleic acid designed to target a selectable marker or other unique sequence in the plasmid form the previous round of engineering.

TABLE 6

SEQUENCE LISTING

| SEQ ID NO: | Sequence |
|---|---|
| SEQ ID NO: 1 | MGKMYYLGLDIGTNSVGYAVTDPSYHLLKFKGEPMWGAHVFAAGNQSAERRSFRTSRRLDRRQQRVKLV<br>QEIFAPVISPIDPRPFIRLHESALWRDDVAETDKHIFFNDPTYTDKEYYSDYPTIHHLIVDLMESSEKHDPRLVY<br>LAVAWLVAHRGHFLNEVDKDNIGDVLSFDAFYPERLAFLSDNGVSPWVCCESKALQATLLSRNSVNDKYKAL<br>KSLIFGSQKPEDNFDANISEDGLIQLLAGKKVKVNKLFPQESNDASFTLNDKEDAIEEILGTLTPDECEWIAHIR<br>RLFDWAIMKHALKDGRTIESKVKLYEQHHDLTQLKFYFVKTYLAKEYDDIFRNVDSETTKNYVAYSYHVK<br>EVKGTLPKNKATQEEFCKVLGKVNIECSEADKVDFDEMIQRLTDNSPMPKQVSGENRVIPYQLYYYELKT<br>ILNKAASYLPFLTQCGKDAISNQDKLLSIMTFRIPYFVGPLRKDNSEHAWLERKAGKIYPWNFNDKVDLDKSE<br>EAFIRRMTNTCTYPGEDVLPLDSLIYEKFMILNEINNIRIDGYPISVDVKQQVFGLFEKKRRVTVKDIQNLLLS<br>LGALDKHGKLTGIDTTIHSNVNTYHHFKSLMERGVLTRDDVERIVERMTYSDDTKRVRLWLNNNYGTLTAD<br>DVKHISRLRKHDFGRLSKMFLTGLKGVHKETGERASILDFMWNTNDNLMQLLSECYTFSDEITKLQEAYYA<br>KAQLSLNDFLDSMYISNAVKRPIYRTLAVVNDIRKACGTAPKRIPIEMARDGESKKKRSVTRREQIKNLYRSIR<br>KDFQQEVDFLEKILENKSDGQLQSDALYLYFAQLGRDMYTGDPIKLEHIKDQSFYNIDHIYPQSMVKDDSLD<br>NKVLVQSEINGEKSSRYPLDAAIRNKMKPLMDAYYNHGLISLKKYQRLIRSTPFTDDEKDFINRQLVETRQ<br>STKALAILLKRKFPDIEIVYSKAGLSDPRHEFGLVKSRNINDLHHAKDAFLALVTGNVYHERFNRRWMVN<br>QPYSVKTKLFTHSIKNGNFVAWNGEEDLGRIVKMLKQNKNTIHFTRFSPDRKEGLFDIQPLKASTGLVPRKA<br>GLDVVKYGGYDKSTAAYLLVRFTLEDKKTQHKLMMIPVEGLYKARIDHDKEFLTDYAQTTISEILQKDKQ<br>KVINIMFPMGTRHIKLNSMISIDGFYLSIGGKSSKGKSVLICHAMVPLIVPHKIECYIKAMESFARKFKENNKLRI<br>VEKFDKITVEDNLNLYELFLQKLQHNPYNKFFSTQFDVLTNGRSTFTKLSPEEQVQTLLNILSIFKTCRSSGCD<br>LKSINGSAQAARIMISADLTGLSKKYSDIRLVEQSASGLFVSKSQNLLEYL\* |
| SEQ ID NO: 2 | MSSLTKFTNKYSKQLTIKNELIPVGKTLENIKENGLIDGDEQLNENYQKAKIIVDDFLRDFINKALNNTQIGNW<br>RELADALNKEDEDNIEKLQDKIRGLIVSKFPETFDLFSSYSIKKDEKIIDDDNDVEEEELDLGKKTSSFKYIFKKN<br>LFKLVLPSYLKTTNQDKLKIISSFDNFSTYFRGFPENRKNIFTTKKPISTIAYRIVHDNFPKFLDNIRCFNVWQTE<br>CPQLIVKADNYLKSKNVIADKSLANYFTVGAYDFLSQNGIDFYNNIIGGLPAPAGHEKIQGLNEFINQECQ<br>KDSELKSKLKNRHAFKMAVLFKQILSDREKSFVIDEFESDAQVIDAVKNFYABQCCKDNNVIFNLLNLIKNIAP<br>LSDDELDGIPFIEGKYLSSVSQKLYSDWSKLRNDIEDSANSKQGNKELAKKIKTNKGDVEKAISKYEFSLSELNS<br>IVHDNTKFSDLLSCTLHKVASEKLVKVNEGDWPKHLKNNEEKQKIKEPLDALLEIYNTLLIFNCKSFNKNGNF<br>YVDYDRCINELSSVVYLYNKTRNYCTKKFPYNTDKFKLNFNSPQLGEGFSKSKENDCLTLLFKKDDNYYVGII<br>RKGAKINFDDTQAIADNTDNCIFKMNYFLLKDAKKFIPKCSIQLKEVKAHFKKSEDDYILSDKEKFASPLVIKK<br>STFLLATAHVGKGKGNIKKFQKEYSKENPTEYRNSLNEWIAPCKEFLKTYKAATIFDIITTLKKAEEYADIVEF<br>YKDVDNLCYKLEFCPIKTSFIENLIDNGDLYLFRINNKDFSSKSTGTKNLHTLYLQAIFDERNLNNPTIMLNGG<br>AELFYRKESIEQKNRITHKAGSILVNKVCKDGTSLDDKIRNEIYOYENKFIDTLSDEAKKVLPNVIKKEATHDI<br>TKDKRFTSDKFFFHCPLTINYKEGDTKQFNNEVLSFLRGNPDINIIGIDRGERNLIYVTVINQKGEILDSVSFNT<br>VTNKSSKIEQTVDYBEKLAVREKERIEAKRSWDSISKIATLKEGYLSAIVHEICLLMIKHNAIVVLENLNAGFK<br>RIRGGLSEKSVYQKPEKMLINKLNYFVSKEKMMNLINKGLLNGLQLSDQFESFEKLGIQSGFIFYVPAAYTSKI<br>DPTTGFANVLNLSKVRNVDAIKSFFSNFNEISYSKKEALFKFSFDLDSLSKKGFSSFVKFSKSKWNVYTPGERII<br>KPKNKQGYREDKRINLTFEMKKLLNEYKVSFDLENNLIPNLTSANLKDTFWKELFFIFKTTLQLRNSVTNGKE<br>DVLISPVKNAKGEFFVSGTHNKTLPQDCDANGAYHIALKGLMILERNNLVREEKDTKKIMAISNVDWFEYVQ<br>KRRGVL\* |
| SEQ ID NO: 3 | MNNYDEFTKLYPIQKTIRFELKPQGRTMEHLETFNFFEEDRDRAEKYKILKEAIDEYHKKFIDEHLTNMSLDW<br>NSLKQISEKYYKSREEKDKKVFLSEQKRMRQEIVSEFKKDDRFKDLFSKKLFSELLKEEIYKKGNHQEIDALK<br>SFDKPSGYFIGLHENRKKNMYSDGDEITAISNRIVNENFPKFLDNLQKYQEARKKYPEWIIKAESALVAHNIKM<br>DEVFSLEYFNKVLNQEGIQRYNLALGGYVTKSGEKMMGLNDALNLAHQSEKSSKGRIHMTPLFKQILSEKES<br>FSYIPDVFIEDSQLLPSIGGFFAQIENDKDGNIFDRALELISSYAEYDTERIYIRQADINRVSNVIFGEWGTLGGL<br>MREYKADSINDINLERTCKKVDKWLDSKEFALSDVLEAIKRTGNNDAFNEYISKMRTAREKIDAARKEMKFI<br>SEKISGDEESIHIIKTLLDSVQQFLHFFNLFKARQDIPLDGAFYAEFDEVHSKLFAIVPLYNKVRNYLTKNNLNT |

TABLE 6-continued

SEQUENCE LISTING

| SEQ ID NO: | Sequence |
|---|---|
| | KKIKLNFKNPTLANGMDQNKVYDYASLIFLRDGNYYLGIINPKRKKNIKFEQGSGNGPFYRKMVYKQIPGPN |
| | KNLPRVFLTSTKGKKEYKPSKEIIBGYEADKHIRGDKFDLFCHKLIDFFKESIEKHKDWSKFNFYFSPTESYG |
| | DISEFYLDVEKQGYRMHFENISAEFTIDEYVEKGDLFFQIYNKDFVKAATGKKDMHTIYWNAAFSPENLQDV |
| | VVKLNGEAELFYRDKSDIKEIVHRREGEILVNRTYNGRTPVPDKIHKKLTDYHNGRTKDLGEAKEYLDKVRYF |
| | KAHYDITKDRRYLNDKIYFHVPLTLNFKANGKKNLNKMVIEKFLSDEKAHIIGIDRGERNLLYSIIDRSGKII |
| | DQQSLNVIDGFDYRREKLNQREIEMDKARQSWNAIGKIKDLKEGYLSKAVHEITKMAIQYNAIVMEELNYGF |
| | KRGRFKVEKQIYQKFENMLIDKMNYLVFKDAPDESPGGVLNAYQLTNPLESFAKLGKQTGILFYVPAAYTSK |
| | IDPTTGFVNLFNTSSKTNAQERKEFLQKFESISYSAKDGGIFAFAFDYRKFGTSKTDHKNVWTAYTNGERMR |
| | YIKEKKRNELFDPSKEIKEALTSSGIKYDGGQNILPDIILRSNNNGLIIYMYSSFIAAIQMRVYDGKEDYIISPIKN |
| | SKGEFFRTDPKRRELPIDADANGAYNIALRGELTMWRAIAEKFDPDSEKMAKLELKHKDWFEMQTRGD* |
| SEQ ID NO: 4 | MTKTFDSEFFNLYSLQKTVFPELKPVGETASFVEDFKNEGLKRVVSEDDERRAVDYQKVKEIIDDYHRDFIEES |
| | LNYPEQVSKDALQAFHLYQKLKAAKVEEREKALKEWEALQKLREKVVKCFSDSNKARFSRIDKKELIK |
| | EDLINWLVAQNREDDIPTVETFNNFTTYFTGFHENRKNIYSKDDHATAISFRLIHENLPKFFDNVISFNKLKEG |
| | FPELKDKVKEDLEVDYDLKHAFEIEYFVNFVTQAGIDQYNYLLGGKTLEDGTKKQGMNEQINLFKQQQTR |
| | DKARQIPKLIPLFKQILSERTESQSFIPKQFESDQELFDSLQKLHNNCQDKFTVLQQAIIGLAEADLKKVFIKTS |
| | DLNALSNTIFGNYSVFSDALNLYKESLKTKKAQFAFEKLPAHSIHDLIQYLEQFNSSLDAEKQQSTDTVLNYFI |
| | KTDELYSRFIKSTSEAFTQVQPLFBLEALSSKRRPPESEDDEGAKGQEGFBQIKRIKAYLDTLMEAVHFAKPYL |
| | VKGRKMIEGLDKDQSFYEAFEMAYQELESLIIPIYNKARSYLSRKPFKADKFKLNFDNNTLLSGWDANKETAN |
| | ASILFKKDGLYYLGIMPKGKTFLFDYFVSSEDSERKLKQRRQKTAEEALAQDGESYFEKIRYKLLPGASKMLPK |
| | VFFSNKNIGFYNPSDDILRINTASHTKNGTPQKGHSKVEFNLNDCHKMIDFFKSSIQKHPEWGSFGFTFSDTS |
| | DFEDMSAFYREVENQGYVISFDKIIKETYIQSQVEQGNLYLFQIYNKDFSPYSKGKPNLHTLYWKALFERANL |
| | NNVVAKLNGEAEIFPRRHSIKASDKVVHPANQAIDNKNPHTEKTQSTFEYDLVICEILVQRSLNTLMSDKGHVNDYQQKLDK |
| | KAQGVSKFNDKVNGFLKGNPDVIIGIDRGERHLLYFTVNQKGEILVQSLNTLMSDKGHVNDYQQKLDK |
| | KEQERDAARKSWTTVENIKELKEGYLSHVVHKLAHLIIKYNAIVCLEDLNFGFKRGRFFKVEKQVYQKFEKAL |
| | IDKLNYLVFKEKELGEVGHYLTAYQLTAPFESFKKLGKQSGILFYVPADYTSKIDPTTGFVNFLDLRYQSVEK |
| | AKQLLSDFNAIRFNSVQNYFEFEIDYKLLTPKRKVGTQSKWVICTYGDVRYQNRRNQKGHWETEEVNVTEK |
| | LKALFASDSKTTTVIDYANDDNLIDVILEQDKCASFFKELWLLKLTMTLRHSKIKSEDDFILSPVKNEQQEFYD |
| | SRKAGEVWPKDADANGAYHIALKGLWNLQQINQWEKGKTLNLAIKNQDWFSFIQEKPYQE* |
| SEQ ID NO: 5 | MHTGGLLSMDAKEFTGQYPLSKTLRFELRPIGRTWDNLEASGYLAEDRHRAECYTPRAKELLDDNHRAFLNR |
| | VLPQIDMDWHPIAEAFCKVVHKNPGNKELAQDYNLQLSKRRKEISAYLQDADGYKGLFAKPALDEAMKIAKE |
| | NGNESDIEVLEAFNGFSVFPTGYHESRENIYSDEDMVSVAYRITEDNPPRFVSNALIFDKLNESHPDIISEVSGN |
| | LGVDDIGKYFDVSNYNNFLSQAGIDDYNHIIGGHTTEDGLIQAFNVVLNLRHQKDPGFEKIQFKQLYKQILSV |
| | RTSKSYIPKQFDNSKEMVDCICDVVSKIEKSETVERALLKVRNISSFDLRGIFVNKKNLRILSNKLIGDWDAIET |
| | ALMHSSSENDKKSVYDSARAFTLDDIFSSVKKFSDASAEDIGNRAEDICRVISETAPFINDLRAVDLDSLNDD |
| | GYEAAVSKIRESLEPYMDLFHELEIFSVGDEFPKCAAFYSELEEVSEQLIEIIPLFNKARSFCTRKRYSTDKIKVN |
| | LKFPTPLADGWDLNKERDNKAAILRKDGKYLALLDMKDLSSIRTSDEDESSFEKMEYKLLPSPVKMLPKIF |
| | VKSKAAKEKYGLITDRMLECYDKGMHKSGSAFDLGFCHELIDYYKRCIAEYPGWDVFDFKFRETSDYGSMK |
| | EFNEDVAGAGYYMSLRKIPCSEVRLLDEKSIYLFQIYNKDYSENAHGNKNMHTMYWEGLFSPQNLESPVF |
| | KLSGGAELFFRKSSIPNDAKTVHPKGSVLVPRNDVNGRRIPDSIYRELTRYFNRGDCRISDEAKSYLDKVKTK |
| | KADHDIVKDRRFTVDKMMPHVPIAMNFKAISKPNLNKKVIDGIIDDQDLKIIGIDRGERNLIVTMVDRKGNI |
| | LYQDSLNILNGYDYRKALDVREYDNKEARRNWTKVEGIRRKMKEGYLSLAVSKLADMIIENNAIIVMEDLNH |
| | GFKAGRSKIEKQVYQKFESMLINKLGYMVLKDKSIDQSGGALHGYQLANHVTTLASVGKQCGVIFYIPAAFT |
| | SKIDPTTGFADLFALSNVKNVASMREFFSKMKSVIYDKABGKFAFTFDYLDYNVKSECGRTLWTVYTVGERF |
| | TYSRVNREVVRKVPTDIIYDALQKAGISVEGDLRDRIAESDGDTLKSIFYAFKYALDMRVENREEDYIQSPVK |
| | NASGEFFCSKNAGKSLPQDSDANGAYNIALKGIIQLRMLSEQYDPNAESIRLPLITNKAWLTFMQSGMKTWK |
| | N* |

TABLE 6-continued

SEQUENCE LISTING

| SEQ ID NO: | Sequence |
|---|---|
| SEQ ID NO: 6 | MDSLKDFTNLYPVSKTLRFELKPVGKTLENIEKAGILKEDEHRAESYRVVKKIIDTYHKVFIDSSLENMAKMG IENEIKAMLQSFCELYKKDHRTEGEDKALDKIRAVLRGLIVGAFTGVCGRRENTVQNEKYESLFKEKLIKEILP DFVLSTEAESLPFSVEEATRSLKEFDSFTSYFAGFYENRKNIYSTKPQSTAIAYRLIHENLPKFIDNILVFQKIKE PIAKELEHIRADFSAGGYIKKDERLEDIFSLNYYIHVLSQAGIEKYNALIGKIVTEGDGEMKGLNEHINLYNQQ RGREDRLPLFRPLYKQILSDREQLSYLPESFEKDEELLRALKEFYDHIAEDILGRTQQLMTSISEYDLSRIYVRN DSQLTDISKKMLGDWNAIYMARERAYDHBQAPKRITAKYERDRIKALKGEESISLANLNSCIAFLDNVRDCR VDTYLSTLGQKEGPHGLSNLVENVFASYHEAEQLLSFPYPEENNLIQDKDNVVLIKNLLDNISDLQRFLKPLW GMGDEPDKDERFYGEYNYIRGALDQVIPLYNKVRNYLTRKPYSTRKVKLNFGNSQLLSGWDRNKEKDNSC VILRKGQNFYLAIMNNRHKRSFENKVLPEYKEGEPYFEKMDYKFLPDPNKMLPKVFLSKKGIETYKPSPKLLE QYGHGTHKKGDTFSMDDLHELIDFFKHSIEAHEDWKQFGFKFSDTATYENVSSFYREVEDQGYKLSFRKVSE SYVVSLIDQGKLYLFQIYNKDFSPCSKGTPNLHTLYWRMLFDERNLADVIYKLDGKAEIPFREKSLKNDHPTH PAGKPIKKKSRQKKGBEESLFEYDLVKDRHYTMDKPQFHVPITMNFKCSAGSKVNDMVNAHIREAKDMHVIG IDRGERNLLYICVIDSRGTILDQISLNTINDIDYHDLLESRDKDRQQERRNWQTIEGIKELKQGYLSQAVHRIAE LMVAYKAVVALEDLNMGFKKRGRQKVESSVYQQFEKQLIDKLNYLVDKKKRPEDIGGLLRAYQFTAPFKSFK EMGKQNGFLFYIPAWNTSNIDPTTGFVNLFHAQYENVDKAKSFFQKFDSISYNPKKDWFEAFDYKNFTKKA EGSRSMWILCTHGSRIKNFNRNSQKNGQWDSEEFALTEAFKSLFVRYEIDYTADLKTAIVDEKQKDFFVDLLKL FKLITVQMRNSWKEKDLDYLISPVAGADGRFFDTREGNKSLPKDADANGAYNILALKGLWALRQIRQTSEGGK LKLAISNKEWLQFVQERSYEKD* |
| SEQ ID NO: 7 | MNNGTNNFQNFIGISSLQKTLRNALIPTETTQQFIVKNGIIKEDELRGENRQILKDIMDDYYRGFISETLSSIDDI DWTSLFEKMEIQLKNGDNKDTLIKEQTEYRKAIHKKFANDDRFKNMFSAKLISDILPEFVIHNNNYSASEKEE KTQVIKLFSRFATSFKDYFKNRANCFSADDISSSSCHRIVNDNAEIFFSNALVRRIVKSLSNDDINKISGDMKD SLKEMSLEEIYSREKYGEFITQEGISFYNDICGKVNSFMNLYCQRNKENKNLYKLQKLHKQILCIADTSYEVP YKFESDEEVVQSVNGFLDNISSKHIVERLRKIGDNYNGYNLDKIYIVSKPYESVSQKTYRDWETINTALEHYN NILPGNGKSKADVKVKAVKNDLQKSITEINELVSNYKLCSDDNIKAETYIHEISHILNNFEAQELKYNPEIHLV ESELKASELKNVLDVIMNAFHWCSVFMTEELVDKDNNFYAELEEIYDEIYPVISLYNLVRNYVTQKPYSTKKI KLNFGIPTLADGWSKSKEYSNNAIILMRDNLYYLGIFNAKNKPDKKIRGNTSENKGDYKKMIYNLLPGPNK MIPKVFLSSKTGVETYKPSAYILEGYKQNKILKSSKDFDITFCHDLITPYKNCIAIHPEWKNFGFDFSDTSTYED ISGFYREVELQGYKIDWTYISEKDIDLLQEKGQLYLFQIYNKDFSKKSTGNDNLHTMYLKNLFSEENLKDIVL KLNGEAEIFFRKSSIKNPIIHKKGSILVNRTYEAEEKDQFGNIQIVRKNIPENIYQELYKYFNDKSDKELSDEAA KLKNVVGHHEAATNIVKDYRYTYDKYFLHMPITINFKANKTGFINDRILQYIAEKDLHVIGIDRGERNLIYV SVIDTCGNIVEQKSPNIVNGYDYQIKLKQQEGARQIARKEWKEIGKIKEIKEGYLSLVIHEISKMVIKYNAIIAM EDLSYGFKKGRFKVERQVYQKFETMLINKLNYLVFKDISITENGGLLKGYQLTYIPDKLKNVGHQCGCIFYVP AAYTSKIDPTTGFVNIFKFKDLTVDAKREFIKKFDSIRYDSEKNLFCFTFDYNNFITQNTVMSKSSWSVYTYGV RIKRRFVNGRFSNESDTIDITKDMEKTLEMTDINWRDGHDLRQDIIDYEIVQHIFEIFRLTVQMRNSLSELEDR DYDRLISPVLNENNIFYDSAKAGDALPKDADANGAYCIALKGLYEIKQITENWKEDGKFSRDKLKISNKDWF DFIQNKRYL* |
| SEQ ID NO: 8 | MTNKFTNQYSLSKTLRFELIPQGKTLEFIQEKGLLSQDKQRAESYQEMKKTIDKFHKYFIDLALSNAKLTHLE TYLELYNKSAETKKEQKFKDDLKKVQDNLRKEIVKSFSDGDAKSIFAILDKKELITVELEKWFENNEQKDIYF DEKFKTFTYYFTGFHQNRKNMYSVEPNSTAIAYRLIHENLPKFLENAKAFEKIKQVESLQVNFRELMGEFGDE GLIIFVNELEEMFQINYYNDVLSQNGITIYNSIISGFTKNDIKYKGLNEYINNYNQTKDKKDRLPKLKQLYKQIL SDRISLSFLPDAFTDGKQVLKAIFDFYKINLLSYTIEGQBESQNLLLLIRQTIENLSSFDTQKIYLKNDTHLTTISQ QVFGDFSVFSTALNWYETKVDKPETEYSKANEKKREIDKAKAVFTKQDYFSIAFLQEVLSEYILTDHTS DIVKKHSSNCIADYPKNHFVAKKENETDKTFDFIANITAKYQCIQGILENADQYEDELKQDQKLIDNLKFFLD AILELLHFIKPLHLKSESITEKDTAFYDVFENYEALSLLTPLYNMVRNYVTQKPYSTEKIKLNFENAQLLNG WDANKEGDYLTTILKKDGNYFLAIMDKKHNKAFQKFPEEGKENYEKMVYKLLPGVNKMLPKVFFSNKNIAY FNPSKELLENYKKETHKKGDTFNLEHCHTLIDFFKDSLNKHEDWKYFDFQFSETKSYQDLSGFYREVEHQGY KINFNIDSEYIDGLVNEGKLFLFQIYSKDFSPFSKGKPNMHTLYWKALFEEQNLQNVIYKLNGQAEIFPRKAS |

TABLE 6-continued

SEQUENCE LISTING

| SEQ ID NO: | Sequence |
|---|---|
| | IKPKNIILHKKKIKIAKKHFIDKKTKTSEIVPVQTIKNLNMYYQQKISEKELTQDDLRYIDNFSIFNEKNKTIDIIK DKRFTVDKFQFHVPITMNFKATGGSYINQTVLEYLQNNPEVKIIGLDRGERHLVLTLIDQQGNILKQESLNTI TDSKLSTPYHKLLDNKENERDLARKNWGTVENIKELKEGYISQVVHKIATLMLENAIVMEDLNFGFKRGR FKVEKQIYQKLEKMLIDKLNYLVLKDKQPQELGGLYNALQLTNKFESFQKMGKQSGFLFYVPAWNTSKIDP TTGFVNYFYTKYENVDKAKAFFEKPEAIRFNAEKKYFEPEVKKYSDFNPKAEGTQQAWTICTYGERIETKRQ KDQNNKFVSTPINLTEKIEDFLGKNQIVYGDGNCIKSQIASKDDKAFFETLLYWFKMTLQMRNSETRTDIDYL ISPVMNDNGTFYNSRDYEKLENPTLPKDADANGAYHIAKKGLMLLNKIDQADLTKKVDLSISNRDWLQFVQ KNK* |
| SEQ ID NO: 9 | MEQEYYLGLDMGTGSVGWAVTDSEYHVLRKHGKALWGVRLFESASTAEERRMFPRTSRRLDRRNWRIEIL QEIFAEEISKKDPGPFLRMKESKYYPEDKRDINGNCPELPYALFVDDDFTDKDYHKKFPTIYHLRKMLMNTEE TPDIRLVYLAIHHMMKHRGHPLLSGDINEIKEFGTTFSKLLENIKNEELDWNLELGKEEYAVVESILKDNMLN RSTKKTRLIKALKAKSICRKAVLNLLAGGTVKLSDIDFGLEELNETTERPKISFADNGYDDYIGEVENELGEQFYII ETAKAVYDWAVLVEILGKYTSISEAKVATYEKHKSDLQFLKKIVRKYLTKEEYKDIFVSTSDKLKNYSAYIG MTKINGKKVDLQSKRCSKEEFYDFIKKNVLKLEGQPEYEYLKEELERETFLPKQVNRDNGVIPYQIHLYELK KILGNLRDKIDLIKENEDKIVQLFBEFRIPYYVGPLNKIDDGKEGKFTWAVRKSNEKIYPWNFENVVDIEASAE KFIRRMTNKCTYLMGEDVLPKDSLLYSKMVLNELNNVKLDGEKLSVELKQRLYTDVFCKYRKTVKKLK NYLKCEGIISGNVEITGIDGDFKASLTAYHDFKEILTGTBLAKDKENIITNIVLFGDDKKLLKKRLNRLYPQIT PNQLKKICALSYTGWGRFSKKFLEEITAPDPETGEVWNIITALWESNNNLMQLLSNEYRFMEEVETYNMGKQ TKTLSYETVENMYVSPSVRKQIWQTLKIVKELEKVMKESPKRVFIEMAREKQESKRTESRKKQLIDLYKACK NEEKDWVKELGDQEEQKLRSDKLYLYYTQKGRCMYSGEVIELKDLWDNTKYDIDHIYPQSKTMDDSLNNR VLVKKKYNATKSDKYPLNENIRHERKGFWKSLLDGGFISKEKYERLIRNTELSPEELAGFIERQIVETRQSTKA VAELLKQVFPPESEIVYVKAGTVSRPRKDFELLKVREVNDLHHAKDAYLNIVVGNSYYVKFTKNASWFIKENP GRTYNLKKMFTSGWNIERNGEVAWEVGKKGTIVTVKQIMNKNNILVTRQVHEAKGGLFDQQIMKKGKGQI AIKETDERLASIEKYGGYNKAAGAYFMLVESKDKKGKTIRTIEFIPLYLKNKIESDESIALNFLEKGRGLKEPKI LLKKIKIDTLFDVDGFKMWLSGRTGDRLLFKCANQLILDEKIIVTMKKIVKFIQRRQENRELKLSDKDGIDNE VLMEIYNTFGKLLENTVYRIRLSEQAKTLIDKQKEFERLSLEDKSSTLFEILHIFQCQSSAANLKMIGGPGKAGI LVMNNISKCNKISLINQSPTGIFENEIDLLK |
| SEQ ID NO: 10 | MNKFENFTGLYPISKTLRFELIPQGKTLEYIEKSEILENDYRAEKYEEVKDIIDGYHKWFINETLHDLHINWSE LKVALENNRIEKSDASKKELQRVQKIKREEIYNAFIEHHAFQYLFKENLLSDLLPIQIEQSEDLDAEKKKQAVE TFNRPSTYFTFGFHENRKNIYSKEGISTSVTYRIVHDNFPKFLENMKVFEILRNECPEVISDTANELAPFIDGVRIE DIFLIDFFNSTFSQNGIDYYNRILGGVTTETGEKYRGINEFTNLYRQQHPEFGKSKKATKMVLFKQILSRDT LSFIPEMFGNDKQVQNSIQLFYNREISQPENEGVKTDVCTALATLTSKIAEFDTEKIYIQQPELPNVSQRLFGSW NELNACLFKYAELKFGTAEKVANRKKIDKWLKSDLFSFTELNKALEFSGKDRIENYFSETGIFAQLVKTGFD EAQSILETEYTSEVHLKDQQTDIEKIKTFLDALQNLMHLLKSLCVSEEARDRAAFYNEFDMLYNQLKLVVPL YNKVPRNYITQKLFRSDKIKIYFENKGQFLGGWNDSQTENSDNGTQAGGYIFRKENVINEYDYYLGICSDPKLF RRTTIVSENDRSSPERLDYYQLKTASVYGNSYCGKHPYTEDKNELVNSIDRFVHLSGNNILIEKIAKDKVKSNP TTNTPSGYLNFIHREAPNTYECLLQDENFVSLNQRVVSALKATLATLVRVPKALVYAKKDYHLFSEIINDIDE LSYEKAFSYFPVSQTEIFENSSNRTIKPLLLFKISNKDLSFAENFEKGNRQKIGKKNLHTLYFEALMKGNQDTIDI GTGMVFHRVKSLNYNEKTLKYGHHSTQLNEKFSYPIIKDKRFASDKFLFHLSTEINYKEKRKPLNNSIIEFLTN NPDINIIGLDRGERHLIYLTLINQKGEILROKTFNIVGNTNYHEKLNQREKERDNARKSWATIGKIKELKEGFLS LVIHEIAKIMVENNAIVVLEDLNFGFKRGRFKVERKQIYQKFEKMLIDKLNYLVFRDKKANEAGGVLKGYQLA EKFESFQKMGKQSGFLFYVPAAYTSKIDPTGFVNMLNAYTNMKDAQTLLSGMDKISFNADANYFEFELD YEKFKTNQTDHTNKWTICTVGEKRFTYNSATKETTVNVTEDLKKLLDKFPEVKYSNGDNIKDEICROTDAKF FEIILMLLKLTMQMRNSNIKTEEDFILSPVKNSNGEFFRSNDDANGIWPADADANGAYHIALKGLYLVKECF NKNEKSLKIEHKNWFKFAQTRFNGSLTKNG* |

TABLE 6-continued

SEQUENCE LISTING

| SEQ ID NO: | Sequence |
|---|---|
| SEQ ID NO: 11 | MENFKNLYPINKTLRFELRPYGKTLENFKKSGLLEKDAFKANSRSMQAIIDEKPKETIEERLKYTEFSECDLG NMTSKDKKITDKAATNLKKQVILSPDDEIPNNYLKPDKNIDALFKNDPSNPVISTFKGFTTYFVNFFEIRKHIFK GESSGSMAYRIIDENLTTYLNNIEKIKKLPEELKSQLEGIDQIDKLNNYNEFITQSGITHYNEIIGGISKSENVKIQ GINEGINLYCQKNKVKLPRLTPLYKMILSDRVSNSFVLDTIENDTELIEMISDLINKTEISQDVIMSDIQNIFIKY KQLGNLPGISYSSIVNAICSDYDNNFGDGKRKKSYENDRKKHLETNVYSINYISELLTDTDVSSNIKMRYKEL EQNYQVCKENFNATNWMNIKNIKQSEKTNLIKDLLDILKSIQRFYDLPDIVDEDKNPSAEFYTWLSKNAEKLD FEFNSVYNKSRNYLTRKQYSDKKIKLNFDSPTLAKGWDANKEIDNSTIIMRKFNNDRGDYDYFLGIWNKSTP ANEKIIPLEDNGLFEKMQYKLYPDPSKMLPKQFLSKIWKAKHPTTPEFDKKYKEGRHKKGPDFEKEFLHELID CFKHGLVNHDEKYQDVFGFNLRNTEDYNSYTEFLEDVERCNYNLSFNKLADTSNLLINDGKLYVFQIWSKDFSI DSKGTKNLNTIYFESLFSENMIEKMFKLSGEAEIFYRPASLNYCEDIIKKGHHHAELKDKPDYPIIKDKRYSQ DKFFHVPMVINYKSEKLNSKSLNNRTNENLGQFTHIIGIDRGERHLIYLTVDVSTGEIVEQKHLDEIINTDTK GVEHKTHYLNKLEEKSKTRDNERKSWEAIETIKELKEGYISHVINEIQKLQEKYNALIVMENLNYGFKNSRIK VEKQVYQKFETALIIKKFPNYIIDKFDPETYIHGYQLTNPITTLLDKIGNQSGIVLYIPAWNTSKIDPVTGFVNLLYA DDLKYKNQEQAKSFIQKIDNIYFENGEFKPDIDFSKWNNRYSISKTKWTLTSYGTRIQTFRNPQKNNKWDSAE YDLITEEFKLILNIDGTLKSQDVETYKKFMSLFKMLQLRNSVTGTDIDYMISPVTDKTGTHFDSRENIKNLPA DADANGAYNIARKGIMAIENIMNGISDPLKISNEDYLKYIQNQQE |
| SEQ ID NO: 12 | MTQFEGFTNLYQVSKTLRFELIPQGKTLKHIQEQGFIEEDKARNDHYKELKPIIDRIYKTYADQCLQLVQLDW ENLSAAIDSYRKEKTEETRNALIEBQATYRNAIHDYFIGRTDNLTDAINKRHAEIYKGLFKAELFNGKVLKQL GTVTTIEHENALLRSFDKFTTYFSGFYENRKNVFSAEDISTAIPHRIVQDNFPKFKENCHIFTRLITAVPSLREH FENVKKAIGIFVSTSIEEVFSFPPYNQLLTQTQIDLYNQLLGGISREAGTEKIKGLNEVINLAIQKNDETAHIIAS LPHRIPLFKQILSDRNTLSFILEEFKSDEEVIQSFCKYKTLLRNENVLETAEALFNELNSIDLTHIFISHKKLETIS SALCDHWDTLRNALYERRISELTGKITKSAKEKVQRSLKHEDINLQEIISAAGKELSEAFKQKTSEILSHAHAA LDQPLPTTLKKQEEKEILKSQLDSLLGLYHLLDWPAVDESNEVDPEFSARLTGIKLEMEPSLSFYNKARNYAT KKPYSVEKFKLNFQMPTLASGWDVNKEKNNGAILFVKNGLYYLGIMPKQKGRYKALSFEPTEKTSEGFDKM YDYFPDAAKMIPKCSTQLKAVTAHFQTHTTPILLSNNFIEPLEITKEIYDLNNPEKEPKKFQTAYAKKTGDQK GYREALCKWIDFTRDFLSKYTKTTSIDLSLSRPSSQYKDGIGEYYAELNPLLYHISFQRIAEKEIMDAVETGKLY LFQIYNKDFAKGHHGKPNLHTLYWTGLFSPENLAKTSIKLNGQAELFYRPKSRMKRMAHRLGEKMLNKKLK DQKTPIPDTLYQELYDYVNHRLSHDLSDEARALLPNVITKEVSHEIIKDRRFTSDKFFFHVPITLNYQAANSPS KFNQRVNAYLKEHPETPIIGIDRGERNLIYITVIDSTGKILEQRSLNTIQQFDYQKKLLDNREKERVAARQAWSV VGTIKDLKQGYLSQVIHEIVLMIHYQAVVLENLNFGFKSKRTGIAEKAVYQQFEKMLIDKLNCLVLKDYP AEKVGGVLNPYQLTDQFTSFAKMGTQSGFLFYVPAPYTSKIDPLTGFVDPFVWKTIKNHESRKHFLEGFDFL HYDVKTGDFILHFKMNRNLSFQRGLPGFMPAWDIVFEKNETQFDAKGTPPIAGKRIVPVIENHRFTGRYRDLY PANELIALLEEKGIVFRDGSNILPKLLENDDSHAIDTMVALIRSVLQMRNSNAATGEDYINSPVRDLNGVCFDS RFQNPEWPMDADANGAYHIALKGQLLLNHLKESKDLKLQNGISNQDWLAYIQELRN* |
| SEQ ID NO: 13 | MAVIKSIKVKLRLLDMPEIRAGLWKLHKEVNAGVRYYTEWLSLLRQENLYRRSPNGDGEQECDKTAEECKA ELLERLRARQVENGHRGPAGSDDELLQLARQLYELLVPQAIGAKGDAQQIARKFLSPLADKDAVGGLGLIAKA GNKPWVRMREAGEPGWEEEKEAETRKSADRTADVLRALADFGLKPLMRVYTDSEMSSVEWKPLRKGQ AVRTWDRDMFQQAIERMMSWESWNORVGQEYAKLVEQKNRFEQKNFVGQEHLVHIVNQLQQDMKEASP GLESKEQTAHYVTGRALRGSDKVFEKWGKLAPDAPFDLYDAEIKNVQRRNTRRFGSHDLFAKLAEPEYQAL WREDASFLTRYAVYNSILRKLNHAKMFAITFTLPDATAHPIWTRFDKLGGNLHQYTFLFNEFGERRHAIRFHK LLKVENGVAREVDDVTVPISMSEQLDNLLPRDPNEPIALYFRDYGAEQHFTGEFGGAKIQCRRDQLAHMHRR RGARDVYLNVSVRVSQSEARGERRPPYAAVFRLVGDNHRAFVHFDKLSDYLAEHPDDGKLGSEGLLSGLR VMSVDLGLRTSASISVFRVARKDELKPNSKGRVPFFFPIKGNDNLVAVHERSQLLKLPGETESKDLRAIREER QRTLRQLRTQLAYLRLLVRCGSEDVGRERSWAKLIEQPVDAANHMTPDWREAFNELQKLLKSLHGICSDK EWMDAVYESVRRVWRHMGKQVRDWRKDVRSGERPKIRGVAKDVVGGNSIEQIEYLERQYKFLKSWSFFG KVSGQVIRAEKGSRFAITLREHIDHAKEDRLKKLADRIIMEALGVYALDERGKGKWVAKYPPCQLILEELS |

TABLE 6-continued

SEQUENCE LISTING

| SEQ ID NO: | Sequence |
|---|---|
| | EYQFNNDRPPSENNQLMQWSHRGVFQELINQAQVHDLLVGTMYAAFSSRFDARTGAPGIRCRRVPARCTQE<br>HNPEPFPWWLNKFVVEHTLDACPLRADDLIPTGEGEIFVSPFSAEEGDFHQIHADLNAAQNLQQRLWSDFDIS<br>QIRLRCDWGEVDGELVLIPRLTGKRTADSYSNKVFYTNTGVTYYRERGKKRRKVFAQEKLSEEEAELLVEA<br>DEAREKSVVLMRDPSGIINRGNWTRQKEFWSMVNQRIEGYLVKQIRSRVPLQDSACENTGDI* |
| SEQ ID NO: 14 | MATRSFILKIEPNEEVKKGLWKTHEVLNHGIAYYMNILKLIRQEAIYEHHEQDPKNPKKVSKARIQAELWDFV<br>LKMQKCNSFTHEVDKDVVFNILRELYEELVPSSVEKKGEANQLSNKFLYPLVDPNSQSGKGTASSGRKPRWY<br>NLKIAGDPSWEEEKKKWEEDKKKDPLAKILGKLAEYGLIPLFIPPTDSNEPIVKEIKWMEKSRNQSVRRLDKD<br>MFIQALERFLSWESWNLKVKEEYEKVEKEHKTLEERIKEDIQAPKSLEQYEKERQEQLLRDTLNTNEYRLSK<br>RGLRGWREIIQKWLKMDENEPSEKYLEVFKDYQRKHPREAGDYSVYEFLSKKENHFIWRNHPEYPLYATF<br>CEIDKKKDAKQQATFTLADPINHPLWVRPEERSGSNLNRLYILTEQLHTEKLKKKLTVQLDRLIYPTESGG<br>WEEKGKVDIVLLPSRQFYNQIFLDIEEKGKHAFTYKDESIKFPLKGTLGGARVQPFRDHLRRYPHKVESGNV<br>GRIYFNMTVNIEPIESPVSKSLKIHRDDPFKFVNFKPKELTEWIKDSKGKKLLSGIESLEIGLRVMSIDLGQRQA<br>AAASIFEVVDKQKPDIEGKLFFPIKGTELYAVHRASFNILPGETILVKSREVLRKAREDNLKLMNQKLNFLRNV<br>LHFQOFEDITEREKRVTKWISRQENSDVPLVYQDBLIQIRELMYKPYDWVAFLKQLHRLEVEIGKEVKHW<br>RKSLSDGRKGLYGISLKNIDEIDRTRKFLLRWSLRPTEPCEVRRLEPGQRPAIDQLNHILNALKEDRLKKMANT<br>IIMHALGYCYDVRKKKWQAKNPACQIILFEDLSNYNPYBERSRPENSKLMKWSRREIPRQVALQGEIYGLQV<br>GEVGAQFSSRFHAKTGSPGIRCSVVTKEKLQDNRFFKNLQREGRLTLDKIAVLKEGDLYPDKGGEKFISLSKD<br>RKLVTTHADINAAQNLQKRFWTRTHGFYKVYCKAYQVDGQTVYIPESKDQKQKLIEEFGEGYFILKDGVYE<br>WGNAGKLKIKKGSSKQSSSELVDSDILKDSFDLASELKGEKLMLYRDPSGNVFPSDKWMAAGVFGKLERIL<br>ISKLTNQYSISTIEDDSSKQSM* |
| SEQ ID NO: 15 | MPTRTINLKLVLGKNPENATLRRALFSTHRLVNQATKRIEEFLLCRGEAYRTVDNEGKEAEIPRHAVQEEAL<br>AFAKAAQRHNGCISTYEDQEILDVLRQLYERLVPSVNENNEAGDAQAANAWVSPLMSAESEGGLSVYDKVL<br>DPPPVWMKLKEEKAPGWEAASQIWIQSDEGQSLLNKPGSPPRWIRKLRSGQPWQDDFVSDQKKKQDELTKG<br>NAPLIKQLKEMGLLPLVNPFFRHLLDPEGKGSVPWDRLAVRAAVAHFISWESWNHRTRAEYNSLKLRRDEFE<br>AASDEFKDDFTLLRQYEAKRHSTLKSIALADDSNPYRIGVRSLRAWNRVREEWIDKGATEEQRVTILSKLQT<br>QLRGKFGDDPLFNWLAQDRHVHLWSPRDSVTPLVRINAVDKVLRRRKPYALMTFAHPRFHPRWILYEAPGG<br>SNLRQYALDCTENALHITLPLLVDDAHGTWIEKKKIRVPLAPSGQIQDLITLEKLLEKKKNRLYYRSGFQQPAGLA<br>GGAEVLFHRPYMEHDERSEESLLERPGAVWFKLTLDVATQAPPNWLDGKGRVRTPPEVHHFKTALSNKSKH<br>TRTLQPGLRVLSVDLGMRTFASCSVFELIEGKPETGRAPPVADERSMDSPNKLWAKHERSFKLTLPGETPSRK<br>EEEERSIARAEIYALKRDIQRLKSLLRLGEEDNDNRRDALLEOPFKGWGEDVVPGQAFPRSLFQGLGAAPFR<br>STPELMRQHCQTYDKAEACLAKHISDWRKRTRPPTSREMWYKTRSYHHGGKSIWMLEYLDAVRKLLLSW<br>SLRGRTYGAINRQDTARFGSLASRLLHHINSLKEDRIKTGADSIVQAARGYIPLPHGKGWEQRYEPCQLILFED<br>LARYRFRVDRPRRENSQLMQWNHRAIVAETTMQAELYGQIVENTAAGFSSRFHAATGAPCVRCRFLLERDF<br>DNDLPKPYLLRELSWMLGNTKVESEBEEKLRLLSEKIRPGSLVPMDGGEQPATLHPKRQTLCVIHADMNAAQ<br>NLQRPFGRCGEAFRIVCQPHGDDLVLSLVLPEEDDTGRITVFRDSSGIFFPCNVWIPAKQFWPAVRAMIWKVMASHSL<br>GKKKIKPLQDNNGDDELEDVLSVLPEEDDTGRITVFRDSSGIFFPCNVWIPAKQFWPAVRAMIWKVMASHSL<br>G* |
| SEQ ID NO: 16 | MTKLRHRQKKLITHDWAGSKKREVLGSNGKLQNPLLMPVKKGQVTEFFRKAPSAYARATKGEMTDGRKNMF<br>THSFEPFKTKPSLHQCELADKAYQSLHSYLPGSLAHFLLSAHALGFRIPSKSGERATAFQASSKIEAYESKLASE<br>LACVDLSIQNLTISTLFNALTTSVRGKGEETSADPLIARPYTLLTGKPLSRDTQGPERDLAEVISRKIASSFGTW<br>KEMTANPLQSLQFFEEELHALDANVSLSPAFDVLIKMNDLQGDLKNRTIVFDPDAPVFEYNAEDPADIIIKLTA<br>RYAKEAVIKNQNVGNYVKNAITTTNANGLGWLLNKGLSLLPVSTDDELLEFIGVERSHPSCHALIELIAQLEA<br>PELFEKNVFSDTRSEVQGMIDSAVSNHIARLSSSRNSLSMDSEELERLIKSFQIHTPHCSLFIGAQSLSQQLESLP<br>EALQSGVNSADILLGSTQYMLTNSLVEESIATYQRTLNRINYLSGVAGQINGAIKRKAIDGEKIHLPAWSELI<br>SLPFIGOPVIDVESDLAHLKNQYQTLSNERFDTLISALQKNFDLNFNKALLNRTQHFEAMCRSTKKNALSKPEIV<br>SYRDLLARLTSCLYRGSLVLRRAGIEVLKKHKIFESNSELREHVHERKHFVFVSPLDRRAKKLLRLTDSRPDL |

TABLE 6-continued

SEQUENCE LISTING

| SEQ ID NO: | Sequence |
|---|---|
| | LHVIDEILQHDNLENKDRESLMVRSGYLLAGLPDQLSSSFINLPIITQKGDRRLIDLIQYDQINRDAFVMLVTS<br>AFKSNLSGLQYRANKQSFVVTRTLSPYLGSKLVVPKDDKDMLVPSQMFEGRFADILQSDYMVWKDAGRLC<br>VIDTAKHLSNIKKSVFSSEEVLAFLRELPHRTFIQTEVRGLGVNDGIAPNNGDIPSLKTFSNCVQVKVSRTNT<br>SLVQTLNRWFEGGKVSPPSIQFERAYYKDDQIHEDAAKRKIRPQMPATELVHASDDAGWTPSYLLGIDPGE<br>YGMGLSVLSINNGEVLDSGFFIHINSLINFASKKSNHQTKVPRQQYKSPYANYLEQSKDSAAGDIAHILDRLIY<br>KLNALPVFEALSGNSQSAADQVWTKVLSFYTWGDNDAQNSIRKQHWFGASHWDIKGMLRQPPTEKKPKPYI<br>AFPGSQVSSYNWLSGNSQRCSCCCGRNPIRQLREMAKDTSIEKLKIRNSEIQLFDGTIKLFNPDPSTVIERRRHNLGPSRI<br>PVADRTFKNISPSSLEFKELITIVSRSIRHSPEFIAKKRGIGSEYFCAYSDCNSLSNSEANAANVAQKFQKQLFF<br>EL* |
| SEQ ID NO: 17 | MKRILNSLKVAALRLLFRGKGSELVKTVKYPLVSPVQGAVEELAEAIRHDNLHLFGQKEIVDLMEKDEGTQV<br>YSVVDFWLDTLRLGMFFSPSANALKITLGKFNSDQVSPPRKVLEQSPFFLAGRLKVEPAERILSVEIRKIGKRE<br>NRVENYAADVETCFIGQLSSDEKQSIQKLANDIWDSKDHEEQRMLKADFFAIPLIKDPKAVTEEDPENETAGK<br>QKPLELCVCLVPELYTRGFGSIADFIVQRLTLLRDKMSTDTAEDCLEYVGIEEEKCGNGMNSLLGTFLKNLQG<br>DGFEQIFQFMLGSYVGWQGKEDVLRERLDLLAEKVKRLPKPKFAGEWSGHRMFLHGQLKSWSNNFFRLFNE<br>TRELLESIKSDIQHATMLISYVEEKGGYHPQLLSQYRKLMEQLPALRTKVLDPEIEMTHMSEAVRSYIMHKS<br>VAGFLPDLLESLDRDKDREFLLSIFPRIPKIDKKTKEIVAWELPGEPEREGYLFTANNLFRNFLENPKHVPRFMA<br>ERIPEDWTRLRSAPVWFDGMVKQWQKVVNQLVESPGALYQFNESFLRQRIQAMLTVYKRDLQTEKFLKLL<br>ADVCRPLVDFFGLGNDIIFKSCQDPRKQWQTVIPLSVPADVYTACEGLAIRLRETLGFEWKNLKGHEREDFL<br>RLHQLLGNLLFWIRDAKLVVKLEDMNNPCVQEYVEARKAIDLPLEIFGFEVPIFLNGYLFSELRQLELLLRR<br>KSVMTSYSVKTTGSPNRLFQLVYLPLNPSDPEEKNSNNFQERLDTPTGLSRRFLDLTLDAFAGKLLTDPVTQE<br>LKTMAGFYDHLFGFKLPCKLAAMSNHPGSSSKMVVLAKPKKGVASNIGFEPIPDDPAHPVFRVRSSWPELKYL<br>EGLLYLPEDTPLTIELAETSVSCQSVVSAFDLKNLTTILGRVGEFRVTADQPFKLTPIIPEKEESFIGKTYLGLD<br>AGERSGVFAIVTVDGDGYEVDQVRGLGVHEDTQLMAIQQVASKSLKEPVFQPLRKGTFRQQERIRKSLRGCVW<br>NFYHALMIKYRAKVVHEESVGSSGLVGQWLRAFQDKLKRADVLPKKGGNGVDKKRESSAQDTLWGGA<br>FSKKEBQQIAFEVQAAGSSQFCLKCGMWFQLGMEVNRVQESGVVLDMNRSIVTFLIESSGEKVYGFSPQQL<br>EKGFRPDIETFKKMVRDFMRPPMFDRKGRPAAAYERFVLGRRHRYRFDKVFEERFGRSALFICPRVGCCNF<br>DHSSSQSAVVLALIGYIADKEGMSCKKLVVRLABLMAEWKLKLERSRVEEQSSAQ* |
| SEQ ID NO: 18 | MAESKQMQCRKCGASMKYEVIGLGKKSCRYMCPDCGNHTSARKIQNKKRDKKYGSASKAQSQRIAVAG<br>ALYPDKKVQTIKTYKYPADLNGEVHDSGVAEKIAQAIQEDEIGLLGPSSEYACWIASQKQSEPYSVVDFWFD<br>AVCAGGVFAYSGARLLSTVLQLSGEESVIRAALASSPFVDDINLAQAEKFLAVSRRTGQDKLGKRIGECFAE<br>GRLEALGIKDRMREFVQAIDVAQTAGQRFAAKLKIFGISQMPEAKQWNNDSGLITVCILPDYVPEENRADQL<br>VVLLRRLREIAYCMGIEDEAGFEHLGIDPGALSNFSNGNPKRGFLGRLLNNDIIALANNMSAMTPYWEGRKG<br>ELIERLJAWLKHRAEGLYLKEPHFGNSWADHRSRIFSRIAGWLSGCAGKLKIAKDQISGVRTDLFLLKRLLDAV<br>PQSAPSDPFIASISALDRFLEAAESSQDPEAQVRALYAFHLNAPAVRSIANKAVQRSDSQEWLIKELDAVDHL<br>EFNKAPPFSDTGKKKKKGANSNGAPSEEBYTEIESIQQPEDAEQEVNGQEGNGASKNQKKFQRIPRFFGEGS<br>RSEYRILTEAPQYFDMFCNNMRAIFMQLESQPRKAPRDFKCFLQNRLQKLYKQTFLNARSNKCRALLESVLIS<br>WGEFYTYGANEKKFRLRHEASERSSDPDYVVQQALEIARRLFLFGFEWRDCSAGERVDLVEIHKKAISFLLAI<br>TQAEVSVGSYNWLGNSTVSRYLSVAGTDTLYGTQLEEFLNATVLSQMRGLAIRLSSQELKDGFDVQLESSCQ<br>DNLQHLLVYRASRDLAACKRATCPAELDPKILVLPVGAFIASVMKMIERGDEPLAGAYLRHRPHSFGMQIRV<br>RGVAEVGMDQGTALAFQKPIESEPFKIKPFSAQYGPVLWLNSSSYSQSYQLDGFLSQPKNWSMRVLPQAGS<br>VRVEQRVALIWNLQAGKMRLERSGARAFFMPVPPSFRPSGSGDEAVLAPNRYLGLFPHSGGIEYAVVDVLDS<br>AGFKILERGTIAVNGFSQKRGERQEEAHREKQRRGISDIGRKKPVQAEVDAANELHRKYTDVATRLGCRIVV<br>QWAPQKPGTAPTAQTVYARAVRTRAPRSGNQEDHARMKSSWGYTWGTYWEKRKPEDILGISTQVYWTG<br>GIGESCPAVAVALLGHIRATSTQTEWEKEEVVFGRLKKFPS* |
| SEQ ID NO: 19 | MEKRINKIRKKLSADNATKPVSRSGPMKTLLVRVMTDDLKKRLEKRRKPEVMPQVISNNAANNLRMLLDD<br>YTKMKEAILQVYWQEFKDDHVGLMCKFAQPASKKIDQNLKFAQPASKIDQNLKPEMDEKGNITTAGFACSQCGQPLFVYKLE |

TABLE 6-continued

| SEQ ID NO: | SEQUENCE LISTING |
|---|---|
| | Sequence |
| | QVSEKGKAYTNYFGRCNVAEHEKLILLAQLKPEKDSDEAVTYSLGKFGQRALDFYSIHVTKESTHPVKPLAQ |
| | IAGNRYASGPVGKALSDACMGTIASFLSKYQDIIIEHQKVVKGNQKRLESLRELAGKENLEYPSVTLPPQHT |
| | KEGVDAYNEVIARVRMWVNLNLWQKLKLSRDDAKPLLRLKGFPSPVVERRENEVDWWNTINEVKKLIDA |
| | KRDMGRVFWSGVTAEKRNTILEGVNYLPNENDHKKREGSLENPKKPAKRQFGDLLLYLEKKYAGDWGKVF |
| | DEAWERIDKKIAGLTSHIEREEARNAEDAQSKAVLTDWLRAKASFVLERLKEMDEKEFYACEIQLQKWYGD |
| | LRGNPFAVEAENRVVDISGFSIGSDGHSIQYRNLLAWKYLENGKREFYLLMNYGKKGRIRFTDGTDIKKSGK |
| | WQGLLYGGGKAVIDLTFDPDDEQLIILPLAFGTRQGREFIWNDLLSLETGLIKLANGRVIEKTIYNKKIGRDE |
| | PALFVALTFERREVVDPSNIKPVNLIGVDRGENIPAVIALTDPEGCPLPEFKDSSGGPTDILRIGEGYKEKQRAI |
| | QAAKEVEQRRAGGYSRKFASKSRNLADDMVRNSARDLFYHAVTHDAVLVPENLSRGFGRQGKRTFMTERQ |
| | YTKMEDWLITAKLAYEGLTSKTYLSKTLAQYTSKTCSNCGFTITTADYDGMLIVRLKKTSDGWATTLNNKEL |
| | KAEGQITYYNRYKQTVEKLSAELDRLSBESGNNDISKWTKGRRDEALFLLKKRFSHRPVQEQFVCLDCGH |
| | EVHADEQAALNIARSWLFLNSNSTBFKSYKSGKQPFVGAWQAFYKRRLKEVWKPNA |
| SEQ ID NO: 20 | MKRINKIRRPLVKDSNTKKAGKTGPMKTLLVRVMTPDLRERLENLRKKPENIPQPISNTSRANLNKLLTDYTE |
| | MKKAILHVTWEEFQKDPVGLMSRVAQPAPKNIDQRKLIPVKDGNERLTSSGFACSQCCQPLYVVKLEQVND |
| | KGKPHTNYFGRCNVSEHERLILLSPHKPEANDELVTYSLGKFGQRALDFYSIHVTRESNHPVKPLEQIGGNSC |
| | ASGPVGKALSDACMGAVASFLTKYQDIILEHQKVIKKNEKRLANLKDIASANGLAFPKITLPPQPHTKEGIEA |
| | YNNVVAQIVIWVNLNLMQKLKIGRDEAKPLQRLKGFPSSPLVERQANEVDWDMVCNVKKLINEKKEDGK |
| | VFWQNLAGYKRQEALLPYLSSEEDRKKGKKPARYQFGDLLLHLEKKHGEDWGKVYDEAWERIDKKVEGLS |
| | KHIKLEEERRSEDAQSKAALTDWLRAKASFVIEGLKEADKDEFCRCELKLQKWVGDLRGKPFAIEAENSILDI |
| | SGFSKQYNCAFIWQKDGVKKLNLYLIINYFKGGKLRFKKIKPEAFEANRFYTVINKKSGEIVPMEVNFNFDDP |
| | NLIIILPLAFGKRQGREFIWNDLLSETGSLKLANGRVIEKTLYNRRTRQDEPALFVALITFERREVLDSSNIKPM |
| | NLIGIDRGENIPAVIALTDPEGCPLSRFKDSLGNPTHILRIGESYKEKQRTIQAAKEVEQRRAGGYSRKYASKA |
| | KNLADDMVRNTARDLLYYAVTQDAMLIFENLSRGFGRQGKRTFMAERQYTRMEDMLTAKLAYEGLPSKT |
| | YLSKTLAQYTSKTCSNCGFTITSADYDRVLEKLKKTATGWMTTINGKELKVEGQITYYNRYKRQNVVKDL |
| | VELDRLSEESVNNDISSWTKGRSGEALSLLKKRFSHRPVQEKFVCLNCGFETHADEQAALNIARSWLFLRSQE |
| | YKKYQTNKTTGNTDKRAFVETWQSFYRKKLKEVWKP |
| SEQ ID NO: 21 | atgGGAAAAATGTATTATCTTGGTCTGGATATAGGAACAAATTCTGTTGGATATGCCGTAACCGACCCATC |
| | GTACCATTTGCTCAAATTTAAAGGCGAACCGATGTGGGGTGCCCACGTGTTTGCTGCGGGAATCAATC |
| | AGCTGAACGGAGAAGCTTTCTCCCGTGATTCTCCAGCCCGACAGCTCCACGTTTTTTATCAGACTTCATGAGAGCGCTT |
| | TCAAGAAATCTTTGCTCCCGTGATTCTCCAGCCCGACAGCTCCACGTTTTTTATCAGACTTCATGAGAGCGCTT |
| | TATGGCGGGATGATGTGGCTGAAACGGATAAACATATTTCTTATGACCCGACCTATACGGATAAGG |
| | AATATTATTCTGACTATCCAACCATCCATCATCCATTGTGACCTTATGGAACAGTGAAAGCATGA |
| | CCCGCGGCTTGTTTATTGGCGTGTCTCTGGCTCGAGTTTCATCGTCATTTCCATCGATCATGTGATGA |
| | AGGATAAATATTGGGATGCTGAGTTTGACGCTTTTCTGAGTTTCTGGCATTTCTTCCGATAAT |
| | GGGGTGTCACCTTGGGTATGTGAGTCAAGCACTCCAAGCAGCCTGCTTCACGAAACTCCGTCAAC |
| | GATAAGTATAAAGCCTTGAGTCTCCAACTTTACAGGAAGCCGGAGGATAATTTTGATGCCAAT |
| | ATCAGTGAAGCATGGCACTTATCCAACTTCAATGAGTAAGAAGTGCAATGGCAATAAACTTTAGGAACGCTT |
| | ACACCGGATGAGTGCAGAACAATCTCCGAATGCGATTAGGAGGCTGTTTGATTGGGCCATCATGAAACATGCT |
| | CTCAAAGATGCAGAACAATCTCCGAATGCGCATATTGCGAAAGTAAAGCTCATGAAGACGATCACATGACTGACA |
| | CAGTCAAGTATTTGTGAAGACCTATCTAGCAGCAGAATATGATGAAGTAAACATTTTCGAACGTAGAGT |
| | GAACAACCAAAACTATGTCGCATATTCCTATCCATGCTAAAAGAAGTGCCATCAAGAATCAAGAATCAGAGAGCT |
| | AAGGCAACCCAAGAGAGAATTTGATGAAATGAATTTTGATGAAGGGTAAAGAACATCGAATGCAGTGAAGC |
| | TGAATAAGGTTGATTTTGAATGAAATGAAATTCCCTTACCAGCGTCTTACAGACAATTCTTTATGCCGAAACAAGTATCA |
| | GGTGAAAACAGGGTTATCCCTTAGCAATGCGGAAAAGATGCCATCTCCAATCAAGATAAGCCGCTT |
| | CTTATCTGCCTTTTTGACCAATGCGAAAAGATGCCATCTCCAATCAAGATAAGCTCCTTCCATCAT |
| | GACCTTTCGATTCGTATTCGTTGGGCCCTTGCGCAAGGACAATTCAGGACGTCTGCCTGGAACGA |

TABLE 6-continued

SEQUENCE LISTING

| SEQ ID NO: | Sequence |
|---|---|
|  | AAAGCAGGGAAAATCTATCCGTGGAATTTAACACAAGTTGACCTTGATAAAGTGAAGAAGCGTTC<br>ATTCGGAGAATGACGAATACCTGCACTTATTATCCCGGTGAAGATGTTTGCCACTTGACTCCCTTATTT<br>ATGAAAAATTCATGATCCTCAATGAAATCAATAATATCCGAATTGATGGTATCCTATTTCTGTAGATGT<br>AAAACAGCAGGTTTTGGCCTCTTTGAAAAGAAGAGAGTGACCGTAAAGGATATCCAGAATCTCCT<br>GCTTTCCTTGGGTGCCTTGATAAGCATGTAATTTGACGGAATCGATACTACCATCCATAGCAATTAC<br>AATACATACCATCATTTTAAATCGCTCATGGAGCGTGGCGTTCTTACTCGTGATGATGTGAACGCATTG<br>TGGAGCGTATGATGACCTATAGTGATGATACAAAACGCGTCCTCTTTGGCCTGATAATAATTATGAACGC<br>TCACTGCTGACGACGTAAAGCATATTTCAAGGCTCATAAGGACATGATTTTGGCCGGCTTTCAAAATGTT<br>CCTCACAGGCCTAAAGGGAGTTCATAAGGAACGGGAGAACGAGCTTCCATTTTGGATTTTATGTGAA<br>TACCAATGATAACTTGATGCAGCTTTTATCTGAATGTATACTTTTCCGATGAAATTACCAAGCTGCAG<br>GAAGCATACTATGCCAGGCCAGCTTCCTGAATGATTTTCTGACTCACATGATATTTCAAATGCTG<br>TCAAACGTCCTATCTATCGAACTCTTGCCCGTTGTAAATGACATACGCAAAGCTCTGGGACGGCCCAA<br>AACGCATTTTATCGAAATGCAAGAGATGGGAAAGCAAAAGAAGGAGCGTAACAAGAAGAGA<br>ACAAATCAAGAATCTTTATAGGTCCATCCGCAAGGATTTTCAGCAGGAGTAGATTTCCTTGAAAAAAT<br>CCTTGAAACACAAAAGCGATGCAGTCCAGCCGCTCTATCTATACTTTGCGCAGCTTGGAAG<br>GGATATGTATACCCGGGGACCCTATCAAGTTGGAGCATATCAAGGACCAGTCCTTCTATATATTGATCAT<br>ATCTATCCCAAAGCATGGTCAAGGACGATAGTTCTTGATAACAAGGTGTTGGTTCAATCGGAAATTAAT<br>GGAGAAGAAGCAGTTCGATATCCCTTGATGCTGCTATCCGTAATAAAATGAAGCTCTTTTGGGATGCTT<br>ATTATAACCATGGCCTGATTTCCCTCAAGAAGTATCAGCGTTTGACGCGGAGCACTCCCTTTACGATGA<br>TGAAAGTGGGATTTCATCATCGGCAGCTTGTTGAGACAAGACAATCCACGAAGGCCTTGGCAATCTT<br>ACTAAAAGGAAGTTCCCTGATACGGAGATTGTCTACTCCAAGGACGCAGGGCTTCTTCTGATTTTCGGCAT<br>GAGTTTGGTCTCGTAAATCGAGGAATATCAATGACCTGCACATGCAAAGGACGCATTCTTCTGCATT<br>GTAACGAGAAATGTCTATCATGAACGCTTTAATCGCTGGTTTATGGTGAACCAGCCTATTCCGTCA<br>AGACCAAGACGTTGTTAAAGTCTATTAAAATGGTATTTGTAGCTGGAATGGAGAAGAGATC<br>TTGGCCGCATTGTTAAAGTTGAAAGTTGTAAAGCAAAATAAGAACACTATTCATTTCACGCGGTTCTCTTTTGATCG<br>AAAGGAAGGCCTGTTTGATATTCAGCACTACAAGCGTCAACCTGTCTGTACAAGAAGCCGGACT<br>AGACCTGGTAAAATATGGTGCTATGACAAATAAAATTGATGATTCCTGTAGAGGCTTGTATAAGCTGATTACACTA<br>GAAGATAAAAAGACTCAACAATAAAATTGATGATTCCTGTAGAGGCTTGTATAAGCTGAATTGAC<br>CATGATAAGGAATTCTTAACGGACTATGCACAAACTACAATCAGTGAAATCCTACAAAAGATAAACAA<br>AAGTTGATAAATAATGTTTCCATTGGAGAAGTCTAGTAAGGAACAAGGCCATTAAACTGAATTCCATGAT<br>GGTTTTATCTTATCTTTCGAGGAAAGTCTAATCGCGATGAGAAATCGGTGTTGTCATGCTATGCTACCTC<br>TTATTGTACCTCATAAGATAGAAATGTTATATTAAGGCGATGGAGTCTTTTGCACGTAAATTAAAGAAAA<br>TAATAAATTAAGGATTGTGGAAAAGTTTGATAAGATTTGAACCTATACGAACT<br>ATTTTTACAAAAACTTCAACATAACCATATAATAAGTTCTTCTTCCACACAATTGATGTGCTGACTAAT<br>GGAAGAAGTACATTTACTAAGTACATTACTCGAGGAACAAGTTCAAACGTTCATTAACGCTGCCAGAATTAT<br>TTAAAACTTGTCGGACCTCTGCTCTGCCTGATTTAAAAAATATTCCGATATTCGGCTTGTGAGCAATCAGCATCT<br>GATCAGCGCAGATTCTTGTAGTAATCACAAAATCTTTTGGAGTATTTAtga |
| SEQ ID NO: 22 | atgtcttcattaacaaaattacaaatacagtaagcagctaacctaacaaatgaactcatcccgagtaagactctggaagaaacgtctcatagat<br>gggatgaacagctaaacgagtaaatatcaaaagagaaattacaaaagcaagaaagataacgttgtgatttcatcgagattctacgagattcataataaccaaataggagaagaat<br>tagcagatgcttttaataaagaaagatgaagataacatagaaagatacaagacaaaatcagaagaataattgtaagtaaattcgagacatttgattgtttcttcttactcgataa<br>agaagaagtaataagtaatgatgatgatgtgaagaaggagctagatcaggaagaaaaactctccattaaatatattttaagaaaaacctttttaattagtac<br>ttcctttctattaaagacaaggattctttgataattttcacctattcagaggattctttgataattttcactatgatgaacacattttctactgaagaagct<br>atatctacgcaattgtccacagaatgtccatgtaaagttctagataacacatcagatgtttaatgtggcacagtccacagttcactgaaggctgata<br>attatttaaaatcaaagaacgtcatagctaaagataaatcttttagcaaactattttactgtaggagcatatgattacttctaccaacaacattatcg<br>gcggctaccagcatttgctgctgtctatttaagcaggtcatgaagaaatcttcagatagaagaaaaagtttgttatagagcagtcgaatcgatagtcaggtcagtcagtcgaatctatgcagaac<br>ttcaaatgctgctgtctcatttaagcaggtcatgaagaaatcttcagatagaagaaaaagtttgttatagagcagtcgaatcgatagtcagaac<br>aatgaaggataataatgtattttaacctctaaatctatcaagaataacgtctctatcgatgatgaattagagtagaggcaagtattaagctctgtttcccaa |

TABLE 6-continued

SEQUENCE LISTING

| SEQ ID NO: | Sequence |
|---|---|
|  | aagctatattcagattggtcgaagcttcgaagtgatattgaagatgaagtagtcgaaacagtaaacaaggaaataaaggcgatgttga aaagccataagtaaatatgagtttctttatcagaacttaacctaaatgtacctgataatacaaggagaaattcagtgaccttcttcttgtacgttacataaagtgctagcgaaaactag tgaagttaatgaagggactggccaaaacacctgaaaatatgaagaaaacaaaagatgagcttagaagcatttgagaaatttataatcattgctgatattcaa ctgcaagtcattaataagaacggtaatttctatgttgattatgcagatgcatcaaatgagctttctagtgttgttcttatttattataacaaaacaaagaaattacttgtacaaagaaacctta taaccagacaaattcaaattaacttaactttgataagaaacctgattgatatgaacaaagaattgactgttcgaaagaaaatgactgctatattaaagaacgacatactatgt tggaatactcagaaaagggcaaaattaactttgatcaagtcaaaaattacttgtaaaaagaagaggcttacttcttaaaaatttgctctcccctttgttattaagaatca tattcctaaatgttcaattcaaatgcaccagcacatgtaaaaagaaagaaaacataaaaaaatcggcaacaatcttcattttgacattacaaactttgagaatctctcattattagaagtgctataattatcaaagatcgtatattgtaagttcaaaatctactggta atcttttgtataaactagagttttgccctattaagaacatcttcttcattgagaatcttattattcagaatctatattaattcagaatcaataataaagattcagtcgaaaagaaactag agaaatagatactcaaccttcagcaatccgcaatcttcagccaatactcctcatatcctataatctcttaaatggagactattaaatggcggaagaagagttgaaccttttatcatgcattgaaca tttattgacatgtctcgatgaagctaaaaggaagagatacacaacaatcttaccaatgagggttttaccttcctcctagcaggaggtaatacacggaataatatacagaccaaaatgaaaagatttgacagagagaaaga aacctatactaactacttgtaattaactgcaatatcatcactaagttgacagcttaattaatggcggaggcagagcagttgaacaaactgtgattatgagaaa agcttgctgtagggaataggatttcataagttggaaaaagagaggatcaaaaagatagaacaatcagaaacgaaatcagaaacgaaatatcatatcagcaagaaacaagggaatattcagagattatgctctctcctctgaataccgatgccaacaggatgatgctt attaacaaactacttgctctaaaagaagagatacacaattttaccaatgattaacatcttaaataacccaaatcagaatcttaaattctatttgagaacaatttaacatttgaagaatattcagaccagttgcatttgagacgaccagtgagaaattccagaccagttaaatatcagcctggatcattaagg gtaagttctgcttttagttgccatatatatcagatgcatgatgaagctctttcttagagtatattcaacaaagt cctgaatcaagagaatacagagatacaatctcgccctaggtgctatcgtgaccaaagtggtgaga aaatgatgggcttaatgatgcactaacagtattgcaaaaaggagtctcttttctttaataacagatgttttta cagagactccacctcaacttttaccatccattggtgggttcttctttgcacaaatagaaaataggacgaga ctattttgacagagcataaacagagtttctaatgattatcttcatcagaatacgatacagaagattatatcag gcaagcggacaataaagagcgactatcaacgacatcaattggagaacatgcaagaaggtaacaagtggc tcgactcaaaggagttgccttatcacagatgtattagaggccactgcaatgagaatgaactcccaatcaataatgatgctt ttaatgaatatatctcaaagataggtgcctacctcaaagatgccactccaggagaatcgatccatattatctgcgcgcgctcaggacattcctcttgatgcgagcattctatgc aacagttttacattttcaattattttcaattattccgatcaaaactgtttcgttccattgttctattgttccgttgtataatagttaggaactatctta gagttcgatgagtccatagcaaactaacttttaattgcagtgttcgttcttaaactaaccactgggctaaactctggccactgcggatgg aaaaaaggaggtgtcctgtaa |
| SEQ ID NO: 23 | ATGACAACTATGATGAGTTTACCAAACTGTACCCAATACAGAAAAACGATAAGGTTCGAATTGAAGCCG CAGGAAGAACGATGAACAATCCTGAAACATTCAACTTTCGAAGAGGACAGGATAGACGCGGAGAA ATATAAGAGATTTTAAAGGAAGCAATCGACGAGTATCATAAGAAGTTTATAGACGAACATCTAACAATAT GTCTCTTGACTGGAATTCTTAAACAGATTTCAGAGAATACTATAAGAAGTAGAGCAGAAAAAAGACAA GAAAGTTTTCTGTCAGAACAGAAACCATGAGGCAAGAAGATAGTTTCTGAGTTCAAAAAGACGATCG GTTTAAAGATCTTTTTTCAAAAAATTTGTTTCTGAACTTCTCAAGGAAGAGATTTACAAAAAGGAAAC CATCAGGAGAATTGACGCATTGAAAAGTTTTGATAAATTCTCAGGCTATTCTCTAACCGTATTGTAAATGAGAATTTCC GAAAAAATATGTATTCTGACGGACGAGATCACGGCTATCTCTAAAAATATCCAGAGTGGATCATTAAGG CAGAGTCTGCTTAGTTGCCATATATATGAGTGATGAAGCTCTTTTCCTTAGAGTATTCAACAAAGT CCTGAATCAAGAGAATACAGAGATACAATCTCGCCCTAGGTGCTATCGTGACCAAAGTGGTGAGA AAATGATGGGGCTTAATGATGCACTTAACAGATTCTGAGTGAAAAAGAGTCCTTTTCTTATATACCAGATGTTTTTA CAGAGAGCTCCACCTCAACTTTTACCATCCATTGGTGGGTTCTTTTGCACAAATAGAAAATGATAAGGACGGGA ATATTTTTGACAGAGCATAAACAGAGTTTCTAATGTTATCTTCATCAGAATACGATACAGAAGATATATCAG GCAAGCGGACATAAACAGAGTTTTCTAATCAACGACATCAATTTTGGAGAACATGCAAGAAGGTAACAAGTGGC TCGACTCAAAGGAGTTGCCTTATCACAGATGTATTAGAGGCCACTGCAATAAAAAGACCGGCAATAATGATGCTT TTAATGAATATATCTCAAAGATGCCTCACTCCAGGAGAATCGATCCATATTATCAAAACCTTATTGGACTCGGTGC TTCATTTCGAAAAATATCTGAGACGAAGACATTATTCAAGACGCGTCAGGACATTCCTCTTGATGGAGCATTCTATGCG AAGTTCGATGAGTCCATAGCAAACTAACTTTTATTGCAGATATAAAGATAAAGCTAAACTTCAAGATCCAACTGCGGAAGATG CGAAAATAACCTTAACACGAAAAGATAAAAGCTAAACTCCAACTCTGGCAAACGGATGG |

TABLE 6-continued

SEQUENCE LISTING

| SEQ ID NO: | Sequence |
|---|---|
| | GATCAAAAACAAGGTATATGACTACGCCTCCTTAATCTTTCTCCCGCATGGTAATTATTATCTCCGAATAA |
| | TAAATCCAAAAAGGAAAAAGAATATTAAATTCGAACAAGGGTCTGGAAATGGCCCATTCTACCCGAAAG |
| | ATGGTGTACAAACAAATTCCAGGCCGTCAAAGGACGAACTTACCAAGAGTCTTCCTCACATCTACGAAAGGC |
| | AAAAAGAGTACAAGCCGTCAAAGGAGTAATAGAAGAGTATAGAAGACTTCTTCAAGGAGCCGACAAACACATAAGAGGAG |
| | ATAAATTCGATCTGATTTCTGTCATAAGCTGATGAGACTTCTTCAAGGAATCCATCGAGAAGCACAAGG |
| | ACTGGAGTAAGTTCAACTTCTATTTCTCTCCAACTGAATCATATGGAGACATCAGCGAATTCTATCTGA |
| | TGTAGAAAAACGGATACCGACGCGATCATTTTGAGATATTTCGCCGAGACGATTGATGAGTATGTCGA |
| | AAAGGGGACTTATTCCTCTTCAGATATACAACAAAGACTTTGTGAAAGCGCAACCGAAAAAAG |
| | ATATGCACACCATTATTGAACGCGGCATTCTGCCCCGAGAACCTTCAGGATGTGGTAGTGAAACTGA |
| | ACGGTGAAGCAGAACTTTTCTACAGAGACAAGAGCCATTCTCACAAGAGATAGTTCACAGGGAGGAG |
| | ATACTGGTCAATCGTACCTACCAACGTGTCCTGACAAGACCACCTGAACAAAAAATTAACAGAT |
| | TATCATAATGCCGTACCCAAAGATCTCGAGAAGCAAAAGAATACCTCGATAAGGTCAGATATTTCAAA |
| | GCGACTACGACATCACAAAGGATCGCAGATACCAGATAAAAATATACTTCCATGTGCCTCTGACA |
| | TTGAATTTCAAAGCAAACGGGAAGAAGAATCTCAATAAGATGTAATTGAAAAGTTCCTCTCGGACGAA |
| | AAAGCGCATATATATTGGGATTGATCGGATAAGGAAATCTTCTTTACTATTCTATCATTGACAGGTCAG |
| | GTAAAATAAATCGATCAACAGAGCCTCAACGCTCATCGATTCGATTGGGAAGATAAGGACCTCAAGGAA |
| | GGGAGATCGAGATGAAGGATGCCAGACAAAGCTGGATCTATGCGAAGATAAACAATGCCATTGTCATG |
| | GGGTATCTTTCAAAAGCGGTTCCACGAAAGCTTACCCAAGATGCGATACAATACAATGCCATTGTCATG |
| | GAGGAACTCAATTATGGGGTTCAAACGCGGACGTTTCAAAGTTGAGAAGCAGATATATCAAATTCGAG |
| | AATATGCTGATTGACAAGATGAATTATCTGGTATTCAAGGATGCTCCGGATGAAAGTCCGGGAGAGTC |
| | CTCAATGCATATCAGCTTACTAATCGCTTGAAAGTTCGCTAAACTTGGGAAACAGACAGGAATTCTTT |
| | TCTATGTTCCGGCAGCCTATACTTCGAAATAGATCCGACCAGCGGGTTGTCAATCTTTTCAATACTTC |
| | AAGTAAAACGAACGCCACAGGAAAAAGAATTCTTGCAAAAATTCGAGTGATCTCCTATTCCGCTAA |
| | AGACGGAGGAGATATATCGCATTCGCCTTCGATTATCGGAAGTTCGAACGTCAAAAACAGACCACAAAA |
| | TGTATGGACCGCATACACGAAGCGGGAAAGAGGGCTCTCACTTCATCAGGAATCAAATAAACGGGCGACAGAACA |
| | TCGACCCCTCGAAGGAGATCAAAGAGGGCTCTCACTTCATCAGGAATCAAATAAACGGGCGACAGAACA |
| | TATTGCCAGATATCCTGAGGAGCAACAATAACGGTCTGATCTACACCAATGTATTCCTCTTCATGCGGC |
| | CATTCAAATAGGGGTCTATGACGGAAAAGAAGGAACTTCGATAGCGGAGAAGTTCATCCGACTCGGAAAAGATG |
| | AGTTCTTCAGGACCGATCCGAAATGACATGCGTGCGATAGCGGAGAAGTTCATCCGACTCGGAAAAGATG |
| | ATTGCTCTCAGGGCGAATTGAACATAAGGACTCGGTTCGAATTCATGCAGACAAGGGGGATTGA |
| | GCGAAGCTAGAACTGAAACATAAGGACTCGGTTCGAATTCATGCAGACAAGGGGGATTGA |
| SEQ ID NO: 24 | ATGACAAAAACATTTTGATTCAGAATTTTTTAATTTATATTCTCTTCAAAAAACAGTTCGTTTTGAACTCAA |
| | GCCGGTTGGTGAAACAGCCTCGTTTGTTGATGAAGATTTTAAAACAAGGTTGAAACGAGTTGTTTCAGA |
| | GGATGAACGCGCGTGGCGGTTGATTCCCAAAAAAGTGAAAGAAATTATGATGACTACCACCCAGATTTTAT |
| | TGAAGAATCGCTAACTATTTCTCCTGAGAACCTATTTCTCAAAAGACGCTTTGAACAGCTTTCACCTTTAT |
| | CAAAAACTAAAGCGCGAACTCTGCTAAGGTTGAAGAGCGTGAAAAGACACGCTTTTCCCGCATTGATAAA |
| | AAAACTGCGCGAAAAAGTTGTTAAATGTTTTTCAGATTCAAACAAGACACGCTTTTCCCGCATTGATAAA |
| | AAAGAACTGATTAAGAAGATTTAATTAACTTACGGGTTTCATGAAGATGACATTCCAACC |
| | GTTGAAACTTTAACAACTTTACGACTTATTTAGGTTTCATGAAGATGACATTCCAACC |
| | AAGACGATCATGCCACAGCCATTCATTGACTCATTCAGAGCTGAATTCATGAAAACAATAACCGAAAAACATTATTCAA |
| | GATCAGCTTTAATAAATTGAAGGAAGGATTTCCAGAGCTGAAATCTCAAGTTGATAAGGTTAAGAAGATTAGA |
| | AGTTGATTATGACTTGAAACATGCCTTTGAAAACTTAGAAGGGACCACCAAAAAGGCAAGCATGAATGA |
| | GACCAATATAACTATCTTTTGCGGGTAAAATCCGACAACAAAGCCCCGACAAATTCCAAACTCATCATT |
| | GTTTAAACAAATTCTAAGCGAACGAACCAGCAACGGCAATCCTGTTATTCCAAGATAAATTTGAATCAGACCA |
| | AGAGTTATTTGACTCACTGCAGAAACTGCATAAACACTGGCAAGATAAAAGTATTCATTAAAAACATCTGATCTTAATGCCTATCA |
| | CATTTTAGGCTTAGCCAAGCAAGACCACAGTGTGTTTTCGGATGCGTTGAATTATCACAAAGAATCGCTCAAACAA |
| | AATACCATTTTTGGAAATTACAGTGTGTTTCGGATGCGTTGAATTATCACAAAGAATCGCTCAAACAA |

TABLE 6-continued

SEQUENCE LISTING

| SEQ ID NO: | Sequence |
|---|---|
| | AAAAGGCGAAGAAGCGTTTGAAAAACTACCCGCTCACAGCATTCATGACTTGATTCAATATTTGGAGC |
| | AATTTAATAGCTCTTTGATGCAGAAAAACAGCAATCAACGAGCACCGTACTGAATTACTTTATTAAAAC |
| | AGACGAACCGTTATTCTCGGTTCATAAACGTCAAAACGTCGTCCACCGGAAGCCTTCACAAGTACAACCACTCTTTGA |
| | ATTGGAAGCATTAAGCTCAAAACGGCATAAAAGCTATTGATACCTTGATGGAGGCGGTGCATTTGCAAAAC |
| | GGTTTGAGCAAATTAAACGCATAAAAGCTATTGATACCTTGATGGAGGCGGTGCATTTGCAAAAC |
| | CACTTTATCTGGTGAAGGGGCGCAAAATGAAGTCGAATAAATTCCAATCACAAAAGCTCGTAGTTATTAAG |
| | TTGAAATGGCTTACCAAGAACTAAGACAAATTCAAATTAATTTTGATTAATTCAATCACAAAAGTTCTTCCGTTGGAT |
| | TCGTAAACCGTTTAAAGCGGACAAAATTCAAATTAATTTTGATAATAATACATTGCTTTCCGTTGGAT |
| | GCTAATAAAGAAACGGCTAACGCTTCAGTTCTTGCTGATTACTTCGTTTCATCGGAAGATTCTGAAAAGTTAAAACAAGAA |
| | CTAAAGGAAAAAACGTTTTTGTTCGAAGAGCTACTTTGAAAAAGTTAAAACAAGAA |
| | GACAAAAAACCGCCGAAGAAGCGCTTACACTTTGAAAAAATTCGTTACAAG |
| | CTGTTACCTCGCGCCAGCAAAATGTTGCCGAAAGTATTTTTTCCAACAAAAACATAGGGTTTTTACAACC |
| | CAAGTGATGACATACTTCGTATCAGGAATACAGCCTCTACACTAAAAGATGATTTCTTAAATCAAGCATTCAAAA |
| | ACTCTAAAGTAGAGTTTAATTGAATGATTGTCATAAGATGATTGATTTCTTAAATCAAGCATTCAAAA |
| | GCATCCAGAGTGGGGAAGTTTTGAATCACTTTCAGATACATCAGATTTTGAAGATATGAGCGCCTTT |
| | TATCGAGAAGTCGAAAACCAAGTTATGTATGCATAGTTCATAAAATCTACAATAAAAGAAACTTACATTCAGAGT |
| | CAAGTTGAACAGGGGAACCTATATTTATTCCAAATCTACAATAAAAGACTTCTCGCCTACAGCAAAGGC |
| | AAACCAAATTACAGGCGTTACTGCAGGAAGGCTAACCTAAATAATGGTGGCAAGATCAAGCATCTGATAAATGGCAC |
| | AAACTCAAATGGTGAAGCGTGAAATTTTCTTTAGGCGACACTCAATCAAAGCATCTGATAAAGTGTGCAC |
| | CCAGCGAATCAAGCATTGACAATAAACCCGCATACGCAAATTCTTCTTCATGTACCGATTTCATTGAACTTTAAGG |
| | CTTGTAAAGACAAGCGCTATACCCCAAGACAAATTCTTCTTCATGTACCGATTTCATTGAACTTTAAGG |
| | CACAAGGTGTTCAAAATTTAACGATAAAGTGAATGATTTTAAAGGTAACCCAGATGTCAATATTA |
| | TTGGCATTGACCGAGGCGAACGACACCTTCTGTATTTCACTGTGAATCAGAAAGGTGAAATTTTGGT |
| | TCAAGAGTCGCTTAATACCCTAATGAGTGATAAAGTCATGTGAATGACTACCAGCAAAAACTCGACAA |
| | AAAAGAACAAGAACCGATGCCGCTCGCAAAAGCTGGACGACGGTTGAAAATATCAAAGAATTAAAAG |
| | AAGGCTATTTATCTCATGTGTTCATAAGTGGCACACCTGATTATTAATAATGCCATTGTTGTTTGCTTG |
| | GAAGACCTGAATTTTGGTTTCGAAACGCGGCCGTTTAAAAGGAAAAAAGAGTTAGGCAAGCAAGTTGATGCCATTAT |
| | AAAGCGCTTATTGATAAGCTTAACTACTTGGATTATTAAAGAAAAAGAGTTAGGCAAGCAAGTGGGCCATTAT |
| | CTAACCGCCTATCAGTTGACCCGACGCTTTGAAAGTTCAAGAAGTTCAAGCCTTTAATGCCATTCGTTTTAATTCAGTACAA |
| | TTTATGTTCCGGCGGATTACACCTCCAAATAGCTCTTAAGCGACTTTAATGCCATTCGTTTTAATTCAGTACAA |
| | AACTATTTTGAGTTCGAAAATAGATTACAAAAACTCACACCCAAACGTAAAGTTGGTACTCAGAGTAAA |
| | TGGGTGATTTGTACCTATGGAGATGTCCGCTAATCAAATCGGCGTAATCAAATCGGGAAACGGAAACG |
| | GAAGAAGTCAATGTGACTGAAAAACTAACCAATTGACGTCATTCTGGAACAGGAAAAGCCAGCTTCTTCAAAGAA |
| | GATTACGCCAATGACAACCTAATTGACGTCATTCTGGAACAGGAAAAGCCAGCTTCTTCAAAGAA |
| | CTGTTATGGTTATTAAAACTCACACCATGATTACAAAACTACAAAAACGTAAAGTTCAGAGACACTTTATTC |
| | TTTCACCCGTTAAAAACGAACAAGGCGAGTTTACGATAGCGAGTTGAAAAGTCGAAAAGCCCGGCGAGGTGTGGCCTAAAG |
| | ATGCAGACGCCAATGGCGCTTATCACATAGCGTTGAAAGGCTTGTGAATCTGCAACAGATCAATCAGT |
| | GGGAAAAGGGTAAAACACTTAATCTGGCGATTAAAAAACCAGGATTGGTTCAGTTTTATTCAAGAAAAGC |
| | CCTATCAAGAATAA |
| SEQ ID NO: 25 | ATGCACACAGGCGGATTACTTAGCATGGATTAGCATGAGGCAAGACTGGCGATAGGCAGAACGTGGGAACAATCTCGAAGCATCGGGGTATCTTGCGAG |
| | CTGCCGTTTGAACTGAACTGAAGACCGATAGGCAGAACGTGGGAACAATCTCGAAGCATCGGGGTATCTTGCGAG |
| | GACAGACACCGTGGAATGCTATCCCAGGGCAAAAGAGCTCTTGGACGACAACCATCGTGCATTCCTC |
| | AACCGTGTCCGTCCTTCAGATCGATATGGATTGGCACCCGATCGCAGAGGCATTCGCAAACGCAGAAGGAGATTTCG |
| | AATCCGGGAAAACAAGGAATTGGCTCAGGATTACAATCTTCAGCTGTCCAAACCTGCATTGATGAAGCAATGAAG |
| | GCCTATCTGCAGGATGCGGACGGGCTATAAAGGTCGTTTTGCCAAACCTGCATTGATGAAGCAATGAAG |
| | ATCGCGAAAGAAACGGGAAATGAATGATCATGAGGTTCTTGAGGCATTCAACGGTTCTCCGTATAC |
| | TTCACCGGATATCATGAGAGCAGGAGAACATCTATTCGACGAGGATATGGTGTCGGTAGCTTATCGC |

TABLE 6-continued

SEQUENCE LISTING

| SEQ ID NO: | Sequence |
|---|---|
|  | ATCACCGAAGACAATTTCCCGAGATTCGTTTCCAATGCCTTATATTCGATAAGCTGAATGAGTCCACC<br>CCGATATAATCTCCGAAGTATCCGAAATCTGGGCGTAGACGACATCGGAAATATTTTGATGTGTCTA<br>ACTACAATAATTTCCTGTCCAGGCCGGTATAGATGACTACATCACATATCGCGGCCATACGACGG<br>AGGACGGTCTGATCCAGGCATTCAATGTTGTTCTGAATCTCAGGCATCAGAAGAGCCCGGATTCGAAA<br>AAATCCAATTCAACAGCTGTACAACAGATACTCAGCGTCCGTACATCCAAATCCTATATCCGAAAC<br>AGTTCGATAATTCGAAGGAGATGGTGGACTGCATCTGCCACTATGTGTCCAAGATCGAAAAATCCGAAA<br>CGGTCGAGAGCATTGAAGCTGGTAAGGAACATATCTTCTTTTGATTTGCCGCGAATATTCGTAAACA<br>AGAAGAATCCCGCATTCTTTCCAACAAACTGATTGGTGATTGGTGACGCGATCGAAACCGCGTGATGC<br>ACTCCTCCTTCGGAAAATGATAAGAAATTCTCAGATGCATCTGCAGAGGATATCGGAAACCGGGCCGAGGACATAT<br>TCTTTTCGTCCGTTAAAAAATTCTGAGACGCTCTCATAAACGATTGACGATTTGACAGTTTGAATG<br>GCAGAGTCATATCTGAGACCGTCCGTTCATAAACGATTGACGATTTGAAATCCAATATATGGATCTGTTTCATG<br>ACGACGGTTACGAGGCGGCCGGTTCCAAGATAAGGGAATCTCTGAACCATATATGGATCTGTTTCATG<br>AACTGGAGATATTCTCCGTAGGCGATGAATTCCGAAATGCAGCTTTCTACAGTGACTTGAAGAAG<br>TCTCCGAACAGCTAATCGAGATTATACCGTTATTCAACAAGGCCCGTTCGTTCGTTCGTACGCCAAGAGATA<br>CAGTACGGACAAGATAAAGTCAATTGAAATTCCCGACCAGTCGCATTGCATCGATCTCGGAT<br>ACGCGACAACAAAGCCGCAATACTCAGGAAAGACGCCAATCAGTTTTGAGAAAATGGAGTACAAGCTTC<br>AAGATCTTTCTTCGATCAGAACTTCGGATTATGGCAGCATGAGGTCAATGAGGATGTTGCAGGGCCGGAT<br>TTCCGAGTCCGGTAAAGATCGTGCCAAGATAGATCTCGGAGGTCTACAGGCGCCAAGGAGAAGTACGGTC<br>TGACCACCGTATGCTGAGTGCTACGATAAAGGATGCACAAGAGCGGCAGTGCATTGCATCTCGGAT<br>TTTGTCACGAATTGATCGATTACTACAAGAGGGTGCATCGCAGAATATCCCGGCTGGGACTGTTCGATTT<br>CAAGTTCAGGGAGAACATCGATTATGCAGCATGAGGAGTTCAATGAGGATGTTGCAGGGCCGGAT<br>ACTATATGTCCCTCAGAAAGATCCCCTTGTTCGGAGGTCTACAGGCTTCTTGATGAGAAATCGATATATCT<br>TTTCCAGATCTACAACAAAGATTATTCCGAAAACGCCTCATGGGAATAAGGACATGCATACCATGTATTG<br>GGAAGGGCTCTTTTCCCCCCAGAATCTGGAATCTGTGTTTAAACTCAGCGGCGTGCGAGCTTTC<br>TTCCGTAAATCCTCCATACCCAATGACGGCCAAAACGGTCCATCCGAAGGGAAGCGTCTTGGTTCCGCGC<br>AATGATGTAAACGGCCGCAGGATACCTGACAGCATATATCTGACAAGGTTCACCAGATATTTCAACCCGGA<br>GATTCCGCATAAGGACGAGGGTTCACGGTGGACAAGATGATGTTCCACGTCCTATCGCATGAATTTCAA<br>TATCGGTGAAAGACAGGAGGTTCACGGTGGACAAGATGATGTTCCACGTCCTATCGCCATGAATTTCAA<br>AGCGATTTCGAAGCCGAATCTCAATAAAAAGGTGATTGACGGCATAATCGACGACTCGACACAACGAGATCTGAAGAT<br>CATCGGCATAGACCGCGGAGAGCCAACCTCATCTACGTACCATGGTGATCGCAAAGGAACATCCT<br>CTATCAGGATAGCCTCAATATTCTGAACCGATACGATTACCGTAAGGCCCTCGACGTCCGCGAATATGA<br>CAATAAAGAGGCTCGGAGGAACTCGAGGTCGAAGGCATCCGTAAGATGAAAGAGGGGTATCTGT<br>CGCTTGCAGTCAGCAGAATTGCAGATATGATCATAGAGAACAATGCGATTATCGTCATGGAGATCTCA<br>ATCACGGATTCAAGGCAGGGCGTTCAAGATGGTCCTTCAAGATAAGTCTATCAGAAGTTCGAATCCATGCTCA<br>TAAACAAACTCGGTTACATGGTCCTTCAAGATAAGTCTATCGATCAGAGCGGCCGAGCTCTCCACGAT<br>ACCAGCTCGCCAACCATGTACATCTGTAGGTAACAAATGTGAGTGATATTCTACATCCC<br>TGCTCGCATTTACATCCAAGATAGAATCCGACAACAGATTTGCAGATCTGTTCGCCCTCAGCAATGTTAAA<br>AACGTGGCATCTATGAGAGAATTTTCTCCAAGATGAAGTCTGTAATTGAAATCGAGTCGGAAGGAAAA<br>TTCGAGTCGAGAGAGATTCAACATACAGGAGTTCAATAGAGAATATGTCGAAGAATATGTCGACCGTGT<br>ATACGGTCGAGAGAGATTCAACATACAGGAGTTCAATAGAGAATATGTCGAAGAATATGTCGACAGAC<br>ATAATCTACGACGCATTGCAAAAGGCAGGAATATCTATGCAAAAATGCTCCGGAGAATTCTTCTGTTCCAAGACGCA<br>TCGATGGCGACACTCTGAAGAGACATATTCTATGCAAAAATGCTCCGGAGAATTCTTCTGTTCCAAGACGCA<br>GGCAAATCGCTCCCTCAGAGTTCCGATCCGAATGCGACAGTATACCCACTCCAAGGGATCCTGCAAG<br>CTACGTATGCTTTCCGAGCAGTAGATCCGAATGCGAAGAGAGCATACGGTTGCCACTGATAACCACAAG<br>GCCTGGCTGACCCTTTATGCAGTCCGTATCCGTATGAAGACATGGAAGAACTGA |
| SEQ ID NO: 26 | atgGATAGTTTGAAAGATTTCACCAATTCGTACCCTGTCAGTAAGACATTGAGATTTGAATTAAGCCCGT<br>TGGAAAGACTTTAGAAAATATCGAAAAGCAGGTATTTTGAAAGGAGGATGAGCATCGTGCAGAAGTT |

TABLE 6-continued

SEQUENCE LISTING

| SEQ ID NO: | Sequence |
|---|---|
|  | ATCGGAGGGTGAAGAAAATAATTGATACTTATCATAAGGTATTTATCGATTCTTCTCTTGAAAATATGGC<br>TAAAATGGGTATTGAGAATGAAATAAAAGCAATGCTCAAAGTTTCTGCGAATTGTATAAAAAGATCA<br>TCGCACTGAGGGTGAAGACAAGGCATTAGATAAAATTCGAGCAGTACTTGTGCCTGATTGTTGGGGC<br>TTTCACTCGTGTTCGGAAGACGGGAAAATACAGTCCAAAACGAGAAGTACGAGAGTTTGTTCAAAGA<br>AAAGTTGATAAAGAAATTTACCTGATTTGTGCTCTCTACTGAGGCTGAAAGCTTGCCTTTCTTCTGTTG<br>AAGAAGCTACGAGGTCACTGAAGGAGTTTGATAGCTTTACATCCTACTTTGCTGTGTTTTTACGAGAATAG<br>AAAGATATATACTCGACGAGAACCTCAATCCAACTTCTTATCGTCTTATCATGAGAACTTGCCG<br>AAGTTCATTGATAATATTCTTGTTTTTCAGAAGATCAAAGAGCCTATAGCCAAAGAGCTGGAACATATTC<br>GTGCGACTTTTCTGCCGGGGGTACATAAAAAGGATGAGAATATAACGCATTGATTGGAAGATTGTGACAG<br>ATTATATCCACGTGTTATCCAGGCTGGGATCGAAAAATAAACATCAACCTTTACAACAAAGAGGCAGAGAG<br>AAGGAGATGAGAGATGAAAGATGCCAATGAACACATCAACTTTACAACAAAGAGGCAGAGAG<br>GATCGGCTCCCTCTTTTAGGCCTCTTATAAACAGATATTGAGTGACAGAGCAATTATCATACTTGC<br>CTGAGAGTTTGAAAAAGATGAGGAGCTCCTCAGGGCTCTATTTCAGAATATGATTTATCTCGATATACGTAAG<br>ACATTCTCGACGTACTCAACAGTTGATGACTTCATTTCAGAATATGATTTATCTCGATATACGTAAG<br>GAACGATAGCCAATTGACTGATATATCAAAAAAATGTTGGGAGTTGGAATGCTATCTACATGCTAG<br>AGAACGAGCATATGACCACGAGCAGGCTCCCAAAAGAATCACGGCGAAATACGAGGGACAGGATTA<br>AAGTCTTAAAGGAGGAAGAGAGTATAAGTCTGGACAAATCTAAAGTGTATGCCTTTCTGGACAATGT<br>TAGAGATTGCCGTGTAGATACTTATCTTTCCACACATGGGCCAGAAGGAAGGACCACATGGTCTATCTAAT<br>CTCGTTGAGAACGTTTTGCCTCCATACCATGAAGCAGAGCAATTGTTGAGCTTTCCATACCCCGAAGAGA<br>ATAATCTGATTCAGGACAAGGACAATGTGTGTAATTAAGAATCTTCGACAATATCAGTGATCTGCA<br>GAGGTTCTGAAACCTCTTTGGGGTGTAGGAGACGAACCGATAAAGATCAGGATGAAAGATTTTATGGAGAGTA<br>TAATTATATCCGAGGAGCTCTAGATCAGGTGATCCTCGTACAATAAGGTAAGAACTACCTACTCG<br>GAAGCCTTATTCGACCAGAAAAGTTCAATTTGGGAATTCAATTGCTTAGTCGTTGGGATAG<br>AAATAAGGAAAAGGATAATAGCTGTGTGATTTGCCTTGTAAGGGCAGAACTTCTATTTGGCTATTATGAA<br>CAATAGGCACCAAAGAAGTTTCGAAAACAAGGTGTTGCCCAGTATAAGGAGGAGAACCTTACTTCG<br>AAAAGATGGATTATAAATTTTGCCTGATCGTATGAAATGCTTCCTAAGGTTTTCTTTCGAAAAAGG<br>AATAGAGATATACAAACCAAGTCCGAAGCTTTAGAACAATATCAGACAACTCAAACACTCAGCTCATGAAGA<br>ATACCTTTAGTAGTATGATGATTTGACGACAAGCTTTGCAGGACTGATTCTTCAAACACTCATTCAGCTCATGAAGA<br>TTGAAGCAATTCAGGGTATAAGCTCTCTTTCGAAAAGTTTCGGAATCTTATGTCTATTCATTAATAGATC<br>GTTGAGGATCAGGGTATTATTTCAGATATACAACAAGGACTTTTCTCCCCTGCAGCAAAGGACACCTAATCT<br>GCATACCTTGTATTGGAGAATGCTTTTGACGAGCGCAATTTGCAGATGTCATATACAAACTGATGGG<br>AAGGCTGAAATCTTTTTCCCAGAGAGAGTTTGAAAATGATCATCCACGCATCCGGCTGGTAAGCCT<br>ATCAAAAGAAAGTCGACAAAAAAGGAGGAGAGAGTCGTTTGAGTATGATTAGTCAAGATAG<br>GCACTATACGATGGATAAGTTCCAGTTCATGTGCCTATTACTTATGAATTTAAATGTTCTGCAGGAAGC<br>AAGTCAATGATATATGGTTAATGCTCTATATTCGAGAGGCCAAAGATATGCATGTCATTGAATTGATCGT<br>GGAGAACGCAATCTCTGTATATAGCGTGATAGATAGTCGAGGGACGATTTTGATCAAATTTCTCTG<br>AATACGATTAACGATATAGACTATCATGATTTATTGGAGAGTCGAGACAAAGACCGTCAGCAGGAGCGC<br>CGAAACTGGCAAATATCGAGGGATCAAGGAGCTGTAGTGTCTTTGGAGGATTTGAATATGGGTTCAAACG<br>GATAGCCGAACTGATGGTGGCTTATACGGGTAGTGTCTTTGGAGGATTTGAATATGGGTTCAAACG<br>TGGGCGGCAGAAGATAGAAAGGCCTGAAGATATTGGAGAAGAAACAGCTGATAGATAAGCTCAACTA<br>TCTTGTGACAAGAGAAGATAGAAAGGCCTGAAGATATTGGAGAAGAAACAGCTGATAGATAAGCTCAACTA<br>CAACATAGATCCGACTACTGGATTTGTTAATTGTTATTTCATGCCCCAGTATGAAAATGTAGATAAAGCGAAG<br>AGCTTCTTCAAAGTTTGATTCAATTAGTTACAACCCGAGAAAGACTGTTGAGTTTGCATTCGATT<br>ATAAAACTTTACTAAAAAGGCTGAAGGAAGTCGTTCAATGGAGTATTATGCACACATGGTTCCCGAA<br>TTAAGTCTCTTTTTGTCGATATGAGATGATTATACCGCTGATTGAAAACAGCTATTGTGACGAAAA<br>GCAAAAAGCTTCTTCGTGATCTTCGAGCTATCAATTGACGATGCGCAACAGCTGGAA |

TABLE 6-continued

SEQUENCE LISTING

| SEQ ID NO: | Sequence |
|---|---|
| | AGAGAAGGATTTGGATTATCTAATCTCTCTGCAGGGGCTGATGGCCGTTCTTCGATACAAGAGA<br>GGGAATAAAAGTCTGCCTAAGGATGCAGATGCCAATGAGCTTATAATATTGCCCTAAAGGACTTTG<br>GGCTCTACGCCAGATTCGGCAAACTTCAGAAGGCCGTAAACTCAATTGCGATTCCAATAAGGAATG<br>GCTACAGTTTGTGCAAGAGAGATCTTACGAGAAAGACTga |
| SEQ ID NO: 27 | atgaataatgaacaaattaacttcagaatttctctcttgcagaagactcttaggaatgctccattccaacgaaacaacacagcaattattgttaaaacggaa<br>taattaaagaagaagatgaagagaaatcgtcagatagcatcatggatgctcagaagggtttcattcagaaacacttatcgtcaattgatgatatgcagga<br>ctctcttatttgagaaatgttcagtgcaaatcagtgaaaatgaagataacaaagacactcttataaaagaacagactgaatacgtaagcaattcataaaaaattgcaatgat<br>agattataaaaatatgttcagtgcaaatcagtgaaaatgaagataacaaagacactcttataaaagaacagactgaatacgtaagcaattcataaaaaattgcaatgat<br>tccagattgcaacgtcattcaaggactattctaaaaacagggctaatgttttcggctgatgatactcttccatctcctgcatgaatagttaatgataatgcagatattttag<br>taatcgctgtgtataggagaatgtataaacgatgatcataataatcggagatatgaataaaatcaaccagataagcagtagtataagtctctcgaagaacttatattctat<br>gaaaaataagggaattattacaccaggaggtatatcttttaataatgataatgtggaagtaaatctattatgaagctacagatgaaggttatcaatcagtaggatctgcca<br>taagctcaaaagtccataaacacatccgttggcaagatatcgtgcatagcagcataacctatagaaggtcacacatcaacgcagctcgtatcaaatccacggtataccaaatcacaaactcctctctttgggcttagtctcttcttggctttgcaacacggtaagctctcgcatccgttagaaaattcttatgtacatcttgcgctctatgatatgtatgaattt<br>cagagctttttaactgaagatattacccgttgcaagagaacttgaaagatatatcaccgtgcgtatatcgaggactttattggtctgcgaatttaactcaattaatcctgtaagatcacaagggctaacagctttgcgcatcagaactaagacaacctaagtcgtatccagagct<br>atatcgaagaaagcttttgaataatccgttataaacaaacagcgcgtaaaaagacaggtcgaaatgaagagccactgcaaaaacaactcaagcgcaaagaccaacttattgatgactcagatatagtgcaaaaaagaaatgaaaaactgaatccttgcaactaacaaatgctacgcaaatatatgaatctagcaggctgaagccaatgtattctgctcaagatcaggtattcagattcaatcttccagcatgcccatagggctcaaactcgcaggtgggctgacccgcagat<br>aacccgaagatgaggacgtctatcaacaagtccaagctttaaagtagttattcaacgcatcctctagcgggctgatacatctgtcggcaagatagatcacacatttgagacatttgcgctgtcggatccttgaatatatcatgcacgggctgaataagaggacgcatctataggcagcaggcggtttttgagatagtgacagaagagagaacctggagaatattacagctctatataagctacttcgtttcaacgcctgcgtctgtcgtccaacgagagtcacagtgaaagaagagattcgtttcaagcaacgtggatccagaggtagtcctgagttcaagaaaaaggcgttctgatgcagatcaagcagtccaaaagcagaaatactctaaaagtccaaattaaagttcctgaaacctataggtgtacttcatctgctggatcggaatacccggattaagaaaactgaagttgaagaactgaaggatttactacagatgaaggtcaagatggaaaacccacttccatcaaggtgatgtttccaccaagtgccaatcaattctctgcaggtgaatgaggcaaggctgaaccttaagcgttgtgaaagagaccaccaagcaaggatttgacatcgggtttccagatcatgcgattcagactttctgatcaattcaatcgcatgaacgatattcgtaatgaagacagaacacaggcaaacgctctttcgcagattatcccaaaccgttttctaatactacccattctcctatttcaccatcttctaccactttccaacacgatattggcgatttcggtgttcaacgcctaaattattatgagataaactataccaagcaatcggtttctgcagatattcatcatgcgatcgaaattgaagacgatgagatgtacagccgtttacaccaaggtaccctgatgggtcgagtctatctcccgtaaatcatgtcaagtggaaagtggtatgcataggattatccccctgcagcaaggtccatcaagaaattttcaaatacgacatttacatatcaatgtgatctaagatcgtaggtattactaccatctgggcgacagtctttacagactcgtttagggttgagcgacgacaggttt<br>aaccgaagatgagcaaatgtcttcaaacaaccaactatctggattttaaaaagagaaaacggataacgacacctaatattcagatatataaaaatatcgtgcccaagatgaacaggtattcaaactgaaattacgagatagcaaccgatatctaatttgatgagaacgccgagcaggcaacctcaaatatattcaaatattttcagtggcgtcaacagtgaggcagtctcacagagggagcagcaatactatatccgctgtctggaaggtggaagcaggcgttctatcaagcgatgcgagctttacagcaggggtcgcattgatctctactatcaatatctttttcttatccaggctaagcgtcacacatttcgaagctgtgatgtgtctacccaggctcctcgtcagagtgggagaagcatcagcggatcatggatcaataacagctttaaacgtgtaactgtttcaacaatatcatcaacaacttctcagatagatgagctggcaggtgctccacctcaagtgatggtatatcactttcaattcgatcaaggacttcaagatccccagagacgtatctggacagattcagctcgtcaagctggtccagctctggagatcgctgactttacacaagaaagcttcgtcctcccccgtaagtactcgttgtcaagtacagcatcaatgactggtgactggttgcaaacctcgtagcagcaaatatatcactgaaccaagcaggcacaaagaagaacatcagattactagaaatccgcggtgcgatggtacggtcattgtttactctcttcttggaataattttcatcttcggtgactggggttcgtttctctttcgatattcttgtataatgaatcctctataaaaaattgtaacttcagcttacagtttccagggagtctgcaatgggccaacagccggcagatcaccatcatcacacagtcactcgtcagggtctttctcttcgccacacttttcaacattcactaggaacctgaaccacattcaaacagtttccagtgcgccgttccatcttctctcgaactaaatcggtgtggcgggagttagccgaacgcttgcgaaagaaaaagctcgcaaagatggatttgcataagtctgcaagacgcgcacgccagaccaaggagccactcgtaatattcctcaggaaatactcaagatgcgaacacctcatagctgttaatgttaccaactcagtaggaagacaagttatcattagcgataatgctaagaagcgcatgctcaagttgcgggaccgtcctaaaagtcgagaaattagcgacatttaaacaatatttttacgacagaggacatgctcccgctccagcatgtatgcacatatttgcacgcagcaatgttgagcaggcattttagcacactgtacggtaaacgcaggagccggcttacatctaaaatcgttagatttcaacagtggcactggcagatgcaggtgcgaaacagcggctttcattctaatcagtcaatgccactccacgagtaacctagaaaatgcgtgaagcagaaggcagtgatgttacatactcaaaagtggttagtaccgtagtcaaggtaaatatctgagttctgaaagtactgtgcaacacggcacatcagctgggaaacacctccgcacaactcataatcaagatccggagccactacagccgttcatgtttggagtcagccacgctggtcaagtgtatctctgtcgtgagcactcagactga |
| SEQ ID NO: 28 | atgacaacaaattacaaaccagtactcgctactgattggttgattccttccaaggaagaaaaacattggaatttattcaagaaaaaggattgctctctcaagataa<br>acaacgagccgagagttatcaagaaatgtacttacagaaatgaaaaactattgataattcataataactattcatgttaagcaatgcaacctcattagaaccattgaatta<br>acaataaaagtgcgaaacaaagaagacgattaccggagaactaaagatagtacaaggacaattaaagagaaaatgttgaaaacaacgaacaaacaacgactatgcaagaaatgtcaaaacgttactactt<br>cattttgcaattttggatcaaaaaagaactgattaccgtagaacctgaaacacaattcggttgaaccaattactacagcaagtgactactgaaatttgacgcatttacagcattt<br>gaaaaatttaaaacaagtagaaagttgcaagttaatttagaggaataaggcttgtggattgggaatttaaagagctgatatcagcaatttcggtccggatttcatgattgattccatgaaagctccaatgaataaagatgaaatgttcaaatcaattat<br>tataatgatgtgctacacaaagtggaattcacaattcatacattatctaaaacaatgtatacacccattggacaatggattttcacttccgttttttggccctgatgttcggtgggaaacaagtcaaatataaacatgaatacatatcaaggtcaaatataaatgatctaaacgtcagcgtttctaaactaccactttctttactgtatcccaagtattggcagttttcggttctcaaactgcctttaaagtatattggtaagagaacaagtaacccagtttatgcatgcacaagaactacctcacaggttgcttcaaaaaccaatctaatccattttctgtttgatgtacccacaacaaataaatttggcatggggagcgtaataactcagacaatatgtgagtcaggacagaaactaccaggtactaacatggaagaaaaataataaatagagctggatgttgacagtaaaaagcggcagaaaaacacaacagtaatataaaggaatgaatttccagaactaaagagttaaattaaaacagctctttttaaggttccaagacaagtatacgttacagaaaagccaaaacttcgatcgagctattccattgtgctcgttactgagggcgataacaagaccatttcgatcgagctattaactgaacacgaagagagacaagaagaattaattatccaaagtatttcgcagtagacagtgaaggtttgttgctactgactaaagagaggtggtattactgtaagacaatttggccgcaaatagacaagtctcgaaaataaaatgaagacattatggcggtttaatgcatcaatccaaacaggaaagatttcaatacaattacaataattaccaaaccaacgaaattgagtttgacattatgagtctccagaatttgcgttggaataattctaaactacaagctacgtcatcaaagaatcgaaatcagtaaaacaatggttcagaataacaagaccaaagagatataattaagacgctgttaaaaacaaagcaggcccactccatttactttttttttgcgacaaggctcaaaggggctatttacaaagaaactgtgtaatccgcagatttgcaccaacccaatttggcaaagggccaaatccaatatttcaatccggtatttttttccagcgtgaaatttcagatttgtgactaattgggcaaaggaagacttattgacagcaatattgacaatatgacaagcatattggctaaaagatggaagagagaaacactgtataggcgttttgttgggcgatcagcgcttttcgtgtttccactgcttaaattattggtatgaagaactaaaatcccaaatgt |

TABLE 6-continued

SEQUENCE LISTING

| SEQ ID NO: | Sequence |
|---|---|
| | ttgaacgaatatagcaaagccaacgacgaaaaaacgagaaatttagataaagcaaagcggtatttacaaacaagatatattttacaagaagtacttcg |
| | gaatacattcttaccttagatcgattcctctgatatgtgaagaagaaatgagcaatcctccaactgtattcgaatattcaaacaagatatttttacaagaagtacttcg |
| | ccttgatttattctaaatattactgcaaatactgcaaaatattcaaggatttagaaaatgcagaccaatacgaagagcaactgcaaaaaatcatttgagaaaatgaacgcaaaa |
| | atcttttagatgctatttagaattgttgcatttattaaccttgcattttaaatcagaaagcattaccgaaaaagacactgcttttgatgtgttgaaaattattacgaagcatt |
| | gagtttgagcccattatataatggtcgaactacccattttgaaaaagacgtaacctgcaaagcgtacgaccagcaaaatcaaatataattgaaaatgcacaatattgaaagttccagaagaa |
| | ccaataaaggaagtgattacttactaccattctagaaaagaaagcatttgcctgaatagaagtatacactgccaaagtttcaaccatcaaaaagttcatgaaaact |
| | aaatatgaaaaaataactgtgataaaaagacgcacaaaaacgtcaattagaacatgtgccaaaagtattttttccaatcaaaaagttactcaaaagtgttagaaaaact |
| | aaaaaagagacgcacaaaatcgatcaagattgagtggtttcaagaatagaagtcacaaaatgagaacatcaattcaaaatatcgattcagaatattgatgttggtgaac |
| | aattactgaaacaatgctatccagattgagtggttttcaaatttacggcaaagttttcccaaagttttccaaaatgctacactttgaattgatggaaagcctatttgaagaacaaaattgcaaa |
| | gaagtaaatgatgctattcaaattgacgttggtcaaaggttttctccaaggaaacgcacactttgatggaatagagcctatatctgacactgatagaccag |
| | tgtcatcaaattgaatgacagccgaataattlittagaaaagtttccgaccctaaatagtcagcaaaagaaacaacaaatatcgccaaaagcagcgtgcttgaat |
| | aaaaaacaaaaactgaaattgtccctgtcaaacaataaaaaaccccatagtaactaccaagaaataagtgaaaagaattaacaacaagatgattaaggtatattg |
| | ataatttagcattttcaatgaaaaaatgaaatggaaaaaaacaatgatatataaaagacaaacgattcgtgatgatggaattcagtgcgttcatgaccgattcgacactgagaccag |
| | cgaagttctatatccaatccaaccgtattagaatattgcaaagacttctaaaatgtgcgaccttcttggatatatctgacactgacactgagaccag |
| | caagaacatccaaaacgacgaataattctaaaatgttggataaacagcagaagcagcagctgttcaatcagcaaaagaagacatttgcaaaa |
| | aattgggaacggtggaaaacatcaagagactcaagaactctaccttcatcagtcaagtgtcataaaatgctacgttgatgctgtggaagaaatgccattgtgtgaatggaag |
| | atttgaatttgattttaaacgtggacgtttaaaagtggaaaaaccaacaattatcaaagtgaaaaatgggtaacatcgggttttgtfatgaccgctggaacacctccaaa |
| | ggaattagccggattgtacaacgcatacaactcaccaagaatgaaagttgcacaactaaaaatgttgcaaagtcaaaatgggtaacatcgggttttgtfatgaccgctggaacacctccaaa |
| | tagaccaccaacgggllgtcaattatttttataccaaagcccaaagcattttgaaaaattggcgctgttcgttcaatgcagaaagaagtattt |
| | tgaattgaagtaaaaacataagcgattttaaccaaagccgaaggcactcaacaagctggactctttggtaaaaaccaaattgtcatcttcaaatctgctag |
| | ccaaaacaacaaattgtaagcactccaattaatctaaccgaaagatagaagacttttaaaatgctcaaatgtttatgtgatggtaattgcatcaattctcgccgtgatgaatg |
| | caagacgcaagcttattgaaacctttatgtgtggtcaaaatctgaaaatctaaatggaaaatccaagcgcgatgcgcaacgacgagcgatcatattgccaaaaaggatttgatgcttt |
| | acacggaacattttacaacgcgaactttatgaaaaatatgaaaaaaagtgattttatctattagtacaacgagtttgttcaattgtacaaaaaataataa |
| | tgaataaaatagaccgactttgacaaaaagtggatttatctattagtacaacgagtttgttcaattgtacaaaaaataataa |
| SEQ ID NO: 29 | atgaacaggagtactattlaggactggatctgaggatgggaaccggatctgtaggatgggcctgttacagatggggcctgttacagatcatgtctgcttcctgctaaacatgggaagtcagctggaaaagcactatgggagt |
| | ccgattatttgaaagtgcatcgacgacagaaaaccgagaagaatgtccgaacatccaagaagaatgtccgaagaagatgagatgccaagactagaagaactgaaatttacaggaaatttttcag |
| | aggaaataagtaagtcagatccaggatttctctcgaatgaaaaagcaaatttcagaagaagaaattcaggagaaaattatcggaactgccatatgcatagaacgcgccatagcattat |
| | tgtgatgacgatgttgttacagatgaatttatcacggacaaatttatcatccaggaaatgtgatgaatacatgtcggaacgacatttcaaagtgtggagatccgataccggttggtatccggc |
| | aattcatcatgatgaactctgaactggacatagggcccatacctcgtattcgtgtaagattgaccattttaagatttcaaaatggaaaatcgatatagacaaccggaatcgctgcaaaaagctctgattaatgagggaatt |
| | aaaactcaactctgaactctgactgactactggcctgcctgaaatgaccggaagtatattgtgttcaaaaggaatattcggtttgaagaatttgaaaagacgaagaagacggaagaatttccttg |
| | ctgataatgatacgatgattatcgaagcgaaagttgaaaatgagctgggaaaacataaatccgattcctatattataagacagtgctgaactggcgtgactgggcgtattagttgaaatatt |
| | gggaaaatatacgcgatttcagaggcggaaatagcaacgtatgcaaaaacataaatccggttacaattgaaaaagataagttgattcagacaaacgtgcagtagaagaa |
| | agatatttgtaagtagtacggacgaatccatacctcgttctgtttcctctgaataattacggaatcgaatatttaaaaagaaaattcttacaagagacaacaggtgaaacag |
| | attcatgatttataagataccgatcagattcattgtccgctataaagcgatcaagaagagtataggaaattacatgtgcaaaggtcagttaaactggttcattat |
| | ggataatggtgtaatccgtattcatttgccgtataaaagctgaatcattatccggagaaatataccatggcctgaaagatataaggtctgcaaaagatacgaagataaactggaattlt |
| | ttgaattcagaatttcaaggatgataaaaataagcagatatattatccggagatcctgggccaaaaactaaaaggcattcatttctcatgtcttacagta |
| | aatatgtggttaaaaataattcttaaggaattgtaaaaggcattcagacactcgctactgaggcaatacactcgcgaagcaatatggaagcaacaactgtaaa |
| | aagatggacatatattcttgaaatgtgagtaaaggacaaagaattctgcatgtcgaaatgatgtggcatcgtaacgcacaatcaatcaattaagaaaacttaagaaatcga |
| | gaagacaagatgaatagtactgcctgagaagattgaactccgaaaaagtctgagaggacattattttaaggatataagacgcataatggaaagacgcaaaagctctgaagagagttctcatcttcggagatatattattattgcc |
| | acgcgaacagtgaattcatttgaagaaatatgtgcgcattaacacggtgggaagattctttaaaagatgctctggcaacagcaagactgtgaatacaccaagtcagatggagagtat |
| | ggaatcattaaccgaattgtgaatcgaaactactgaaaataactcggctcaattattaagtaatgatcggcaatttaaggtaataatggaaagtaatggacttaagagactaaaac |
| | attgcgtacgaacagtagagaataatgtgttttctcctctgaagagactggcacgaagatattagggaatttgaaagtataaggtaaatggctgtatctcggcagcagggaaactctgcga |
| | acgtgtatttattgatgtgccgaggaactgcaaaaatttaccaaggaaccgatcgctatattatacgcaaaaagtcgtgtattccaaaactaagaacggaaattgaagaaatgaactttggg |
| | cttatatgggtaataacaaaataatgaagacactgagagaaaagcttttggagagttcacctgtagatcggtgcgtattaagacgcacataatcggcgtttaataatggcgaaagatgaagactggaaaga |
| | taagtccattaaatgaacaaggcttaataagcttgaagtcactgtgatagaagggttagtctaagtaatgaacgcttaataagaagaaaactgacgcttaataatgaacgcttaataagaaaacacagaa |

TABLE 6-continued

SEQUENCE LISTING

| SEQ ID NO: | Sequence |
|---|---|
| | ttgagtccgaagaattagcaggattattgaaggcagattgttgttgaattactgaaggtcagagtacaaagtgaattgt<br>atatgtcaaagcagtacgttccaagattcagaaatttcaagattactgaaggtcgagaagtgcatcacgcaaaggatgattgcttactaaagcaagtgtttccgaaagtgaattgt<br>tagttattgtgaaatttactaagaatgcatcatggtttataaagaaatccggaactgactactacaacttaaaaaagtgttacatcaggtgaatattgaacgaaatggaga<br>agtgtcatggaagtcggaaaaaaaggaaaacaattgtaacgtaaaacaaacaataatgaataaacatattaatattgtgacaagagacaggtcatgaagcgaaagtgggctgttt<br>gatcagcagattatgaaaaaaggaaaaagtcagattgcttgtaaaggaaacctgactgcagattgtgaaggatgatgaaacgtctgcatgaaaacgatataaatggcggcatttt<br>tatgtcgtgatccctaaagatgaaagatgaaaccaaagaactacctgattctgattctgaaatccgaacgatagaattcactatatattaaagaatcagcagcatttaaaagaagaacttgaacacttttaga<br>aaaaggcagaggtttgaaaataccaaatgaacaaatgagtgacgatatatacaatcatacataatgtgacgattcaaaatgtgctgtctgaagaacaagggacagact<br>actatttaaatgtgcaaatcaatgattttgatgagaaatattataagtaacaatgaaaaaatgtaagtattcaaggagaccaagaagaatgatatatgatagaaa<br>gatgaaatgataatgaaagattactgttgagagaatatatataaaagtagtactgttgtttaaagtgtaacacaagtgtatagaaacacgatcatccgaacagtagtcaatttttcagtgctaaaaggtgataaca<br>aaaaagaatttgaaaagttaccacctgaggataaaagtagtactgtcaacaaaattctattatacaagtgtaacaaattcaaccaggaaatttcgaaaatgagatgattgttaaagat |
| SEQ ID NO: 30 | ATGAAATCTTTCGATTCATTCACAAATCTTTATTCTCTTTCAAAAACCTTGAAATTTGAGATGAGACCTGT<br>CGGAAATACCCAAAAAAATGCTCGACAATGCAGGACTATTTGAAAAGACAAACTAATTCAAAAAAGT<br>ACGGAAAAACAAGCGTATTCGACAGAACTCCACAGAGATTTATAGAAGACGCTACCAGGGGGTA<br>GAGCTAATAGGACTAGATGAGAACTTTAGGACACTTGTTGACTGCTGCAAAAAGATAAGAAAATATGTC<br>GCAATGAAAGCGTATGAAAATAGTTTGCAGCGCTGAGAACGTAAAAATAGGCTGAAAATAAAAATATTTAACCTAAA<br>GGCTGAGGATTGGGTAAAGAACAAATATCCAATATTAGGGCTGAAAAATAAAATACCGATATTTTATT<br>CGAAGAGGCTGTATTCGGGATATTGAAAGCCGTATATGGAGAAGAAAAAGATACTTTATAGAAGTAG<br>AGGAAATAGATACCGGCAAATCAAAGATCAATCAAAGAATTTTACAAAACGACGGAACTTCTACAGCAA<br>CAGGATATATTTCAAAAATTTTGAAACCAGAAAACGAGAATTTTACAAAACGACGGAACTTCTACAGCAA<br>TTGCTACAAGGATCATTGACAAAAATCTGAAAAATTCATAGATAATCTGTCAATAGTTGAAAGTGTGA<br>GACAAAAGGTTGATCTCGCCGAGACAGAGAAATCTTTCGACCATATCTCTAATCTTTCCAATAGA<br>CTTTTATAACAAGTGTCTCCTTCAAGATGCTATTGATTACTACAACAAGATAATCATATAGGTGAGAAACTCTC<br>AAAAATGGCGAAAACTAATAGGTCTCAATGAACTAATAAATAAATACAATGACAGAATAATAAGGATCA<br>GAAAATCCCATTTTCAAACTTCTTGATAAACAAATTTGAGTGAAAAGATATTATTTTTGGATGAAATA<br>AAAAATGACACAGAACTGATCGAGGCCCTGAGTCAGTTCGCAAAAATAATTCCAAATACGATTTGCACAGATTTATATTTCC<br>TGTCAAAAGCTTTTTGCCGATTTTGTAGAAAATAATCAAAATCGATTTGCAATTTTCTATACGAGTT<br>CAAGAAGCATTCAATACTATATCAAACAAGTGGACAAGTGGAACAAGCCAATAATTGAGACGTTCGCAATTTTCCTAAATATCTATTC<br>GAAGCAATGAAGAGTTGGAAAACTTGCAGCGAAATGGAGCAGATTGATATTCAAAAGATTCAAAGTCACAAT<br>ATTGCCTTTTCACGATGAAGAGTGCTTTTATTAAGTATCAGCCTTGAGGGACATTTTCAAATTTTCTATAATCTATTC<br>ACTACAAAAATTCAAAATTCAAGAGAGACCAATTGGGACCAATTGTTACCAGCCAGACAGTTTTACAGTTTTAT<br>GATAACGCCTACGAGGATATTGTGCAGGTATACACAAGCTTCGAAACTATCTGACCAAAAGCCATAT<br>AGCGAGGAGAAATGGAAGTTGAATTTGAAATTTCTACCGCTGGCAAATGGATGGATAAGAACAAAGA<br>ATCTGATAATTCAGCAGTTATTCTACAAAAGGTGGAAAATTATTGGAATTATTTGGAATTACTAAGGACA<br>CAACAAAATTTGATGACCGTTTCAAGAAATTTCAAGCTGAAATTAATTGAAGGTGAATGAAATTATGAAAA<br>AATAGTCTATAAATTTTCCCGACCGATCAATTCTGTAAAAAATGTTTCCAAAGTGCTTTTCGCAAAGGAGACTC<br>GAATTTTAGCCGCTCGAAGATATGCAGAAGTGATTTATATTTTAATAAGATTGCTTGACTAAATATGAAGGCTGG<br>TATTCAATAGATAGTATGCGAGAAGTTGATTGATTTTATAAAGATTTCGACTAATATATTCATGAAAAAACG<br>CATGTTATACCTTTCGGCACTAAAACCCACAGGAATACCAAATATTCGAGATCAATATTCATGAAAAAACG<br>ATGTTGCAGAGACGGATACAGGATTGATTTCAAGGCATTTCAGATCAATAAAAGATGAATTTTCGAG<br>AGAAAGGCGAACTTCACCTTTTGAAAATCCACAATAAGATTTCGAATCGCTCTTTTCAAACGATAATGTTGT<br>AGTCAAAACTTTCCAATAAACTCAATGGTCAAGCTGTCAATATTTTTATAGACCGAAAACGAAAAGACAA<br>ATTAGAATCAAAAAGATAAAGAAGGAATAAGGATGATTGACCATAAAGCTATAGTGAGAATAAGA |

TABLE 6-continued

SEQUENCE LISTING

| SEQ ID NO: | Sequence |
|---|---|
| | TTTTTTTCATGTCCTCTCACACTAAACCGACTAAAACGCACTCATATCGCTTTAATGCTCAAATCAAC<br>AACTTTCTGCAAATAATAAGATATCAACATCGGTGTAGATAGGGAGAAAAGCATTAGTCTAT<br>TATCGGTGATTACACAAGCTAGTGACATCTTAGAAAGTGCTCACTAAATGAGCTAAATGGCGTGAAT<br>TATGCTGAAAAACTGGGAAAAAGGCAGAAAATCGAGAACAAGCACGCAGAGACTGGCAAGACGTAC<br>AAGGGATCAAAGACCTACATTATCATTCTTGAAGAAGATATATTCCAGGTGGTGCAGAAGCTTGCTGATTAGCAATTA<br>AACACAATGCCATTATCATTCAACAGTAGAAAAAGCACTGATGATAATAAGCTTCTTGTAGACAAAGGTGAAA<br>AATCCATTTATCAACATCCTGAAAAGCATATCGAAGCATATCAGCTTTCGCCCCATTTGAGACATTTCAAA<br>AAAATCCCGAGCAAGCAGGAGCATCTTCTGAAAGCATATCCACAAGCTTCGTATACCTCAAAAGTGACCCTGTAA<br>AAATGGGCAAACAGACGGGTATAATCTTTTATACACAAGCTTCGTATACCTCAAAAGTGACCCTGTAA<br>CAGGTTGGCGACCACCTGTATCTCAAATATTTCAGTGCCAAAAAGCAAAAGACGATATTGCAAAGT<br>TTACAAAATAGAATTGTAATGATAAGGTTGAGCTTACCTATGATATAAGGACTTTCAGCAAGCAA<br>AAGAATATCCAAATAAAACTGTTTGGAAAGTTTGCTCAAATGTAGAGAGATATCAAGAGCTTTTACAA<br>TCAATCAAAACAAAGGCGGATATACTCACTACACAAAGATTTGCTCACACAGATTTCTACAATTGAGAAATACCAAAATACCT<br>CATTTTTAGAGATTTATTTTTATTTTTATTCAACCTATTTGCCAAATACCGATGATTCTGAGATT<br>GCTAAAAAGAAATAAACTTCCTGAAAATGGAGAATGATAACGGCGTATAACGAAAAACGAAATGCGAGAAAGGATTGT<br>AATGAAAATAAACTTCCTGAAAATGGAGATGATAACGAAAACGAAAATGCGAGAAAGGATTGT<br>CATACTCAACAAATCTCACAATATTCAGAGAATGAATAACTGCGAGAAAATGCGAGAAAATGAAATGGGGGATT<br>TGTATGTATCAAACATTGACTGGGACAATTTTGTAACCCAAGCTAATGCACGGCATTAA |
| SEQ ID NO: 31 | ATGATTATCTTATATTAGTACCTCGAATATGAATATGAACATGGAAGAGTATTTATGGAAAATTTAAAACT<br>TGTATCCAAATAAACAAAACACTTCGATTTGAATTAAGACCCTATGGAAAACATTGGAAAATTTTAAA<br>AATCCGGACTTTGAGAAAAGATGCCTTTAGAGACGCAAATAGTAGACGAAGCTATGCAAGCTATAATCGATG<br>AAAATTCAAAGAGACTATCGAAGAAGCGCTTAAAGTACACTGAAATCAGTGAATGATGTTCTTGGAAACA<br>TGACATCAAAAGAGATAATATTTAATAATTACCTAAGAAGCAGCTTGATAAGAACCGATGATAAATGGTGCCATTATTGACGACATAATTGACGCATATTTTAAATGATCC<br>TTCAAATCCTGTAATCTCTACATTTTAAAGTTTTAGACATAATTGTAGATAATTTTTGTGAATTTTTTGAAATTCGAAAAC<br>ATATTTCAAGGGAGAATCATCAGCTCAATGCACAAGAATTAAAATCAAGCTAGAGAAGCATTGATCAG<br>TGAATAATATTGAAAAATATAATAAATCAGAAGATGTCAAAATACAGGAATTAATGAAGAATGATCAAGAAGCATATGAAATATCAGA<br>GCGGTATATCAAAATCAGAGAAGTGTCAAAATACAGGAATTAATGAAGGAATTAATCTATACTGTCAGA<br>AGAACAAAGTTAACTTCCTCGACTCCGCTATACAAATGATATATATCAGACAGAGTTTCCAACTC<br>TTTTGTATTAGACACTATTGAAAATGACACAGAATTAATTGAAATGATAAGTGATTTGATTAATAAGACT<br>GAGATTTCGCAAGATGTTATATGTCAGATATTCAGATATATCAGAATATATTCAGATATTTCATAAAATACAAACAACTTGGTAATT<br>TGCCCGGTATCCATATTCTCAATAGTTAATTCTTATTTGCTCGATTATGACAACAATTTCGGAGATGG<br>GAAGCAGAAAAAATCTACGAAAAAGCATTGGAGACATTGGAGACATTGGAGAGAATGATCCTCAAAATGATCCTCAAAATAATGTATACTCCATAATTA<br>TATTTCTGAATTGCTTACAGATACCCGATGTTTCATCAAATATCAAGATGAGATATAAAGAGCTTGAGCAA<br>AATTATCAGGTTTGCAAAGAAAATTTAATGCCACAAACTGGAATGAATATTAAAATATAAACAATCT<br>GAAAAACAACCTTATTAAAGATTTGTTAGAATATACTTAAACTGATTCAACGTTTCTATGATTTGTTTG<br>ATATTGTTGACGAAGATAAAAATCCTGAATTTTATACCTGGTTTATCAAAAAATGCTGAAAAGC<br>TTGACTTTGAATTCAATTCTGTATATAACAAGTCACGAAACATTCTCACCAGGAAACAATACTCGATAA<br>AAAAATCAAGCTGAATTTTGATTCTCCAACATTGGCAAAGGGTGGGATGCTAACAAGAAATAGATAA<br>CTCCACGATTATAATGCGTAAATTTAATAATGCACAGAGGCGATTAGATTACTTCCTTGGCATATGGAAT<br>AAATCCACCACCTGCAAATGAAAATAAATCCCGAGGTAATGATTATTCCGAAAAATGCAATAT<br>AAGCTGTATCCAGATCCTAGTAAGATGTTACCGAAACAATTCTATCAAAAATATGGAAGGCAAAGCAT<br>CCTACGACACCTGAATTTGATAAGAAATATAAGAGGAAGACATAAAAAAGGTCCTGATTTCGAAA<br>AGAATTCTGCTCAATCTCGTAACACTGGCTTTGATGGCTTGATTGATCATATACGAGTTCTCGAAGATCAGGAT<br>GTTTTGGCTTCTCGAAATTGATGAAAATATAAACTGCTGATCTTCAAACCTTATTATTAATGATGGAAATTGTA<br>GATGCAATTACAATCTTTCATTTAACAACAAATTGCTGATACTTCAAACCTTATTATTAATGATGGAAATTGTA |

TABLE 6-continued

SEQUENCE LISTING

| SEQ ID NO: | Sequence |
|---|---|
| | TGTATTTCAGATATGGTCAAAAGACTTTTCTATTGATTCAAAAGGTACTAAAAACTTGAATACAATCTAT
TTTGAATCACTATTTTCAGAAGAAAACATGATAGAAAAAATGTTCAAGCTTTCAAGCTTTCTGGAGAGGCTGAGATA
TTCTATCGACCAGCATCGTTGAATTATTGTGAAGATATCATAAAAAAAAGTCATCACCATGCAGAATTA
AAAGATAAGTTTGACTATCCTATAATAAAAGATAAGCGATATTCCAAGATAAGTTTTTCTTTCATGTGC
CAATGGTTATAAATTATAAAATCTGAGAAACTGAATTCCAAAAGCCTTAACAACCGAACAAATGAAAACC
TGGGACAGTTTAACACATATTATAGGTATAGACAGACAGGGCGGCACTTGATTTATTTAACTGTTGTTGA
TGTTTCCACTGGTGAAATCGTTGACAGAAATCATTGGACGAAATTACAATACTAGCTCAAGGAGT
TGAACACAAAACCCATTATTTGAATAAATTGGAAGAAAAATCTAAAACAAGAGATAACGAGCGTAAAT
CATGGGAAGCTATTGGAAACTATCAAAGAATTCAAAGAAGGCTATATTCTCATGTAATTAATGAAATAC
AAAAGCTGCAAGAAAAAATATAATGCTTAATCGTAATGAAAAATCTTAACTATGGGTTCAAAAACTCAC
GAATCAAGTTGAAAATTGAGACAGCAGCATTGATTAAAAAGTTCAATTATATTA
TTGATAAAAGATCCAGAAACCTATATACATGGTACCAGCTTACAAATCCTATTACCACCTCTGATAA
GATTTGGAAATCAATCTGGAATAGTGCTGTATATTCCTGCGTGGAATACTTCTAAGATAGATCCGTCACA
GGATTTGTAAACCTTCTGTACGCAGATGATTTGAAGTATAAAATCAGGAGCCAGGCCAAATCATTCATT
CAGAAAATAGACAACATATATTTGAAAATGGAGAGTTTAAATTGATATTTTCCAAATGAAATA
ATCGCTACTCAATAAGTAAAACTAAAGTGGGATTCTGCTGAATATGATTTGACAGAAGAATTCATGTCTTTATTTAAACTAA
ATCCCAGAAAAACAATAAGTGGGATTCTGCTGAATATGATTTGACAGAAGAATTCATGTCTTTATTTAAACTAA
TGCTACAGCTTCGAAACTCTGTTACGGACCGACATTGATTATATGATCTCTCCTGTCACTGATAAAAC
AGGAACACATTTCGATTCAAGAGAATAATGGCTATTGAAAGAAATATTAAAAATCTTCCTGCGATGAACGTATAAGCGATCCACTAAGAA
CAACATTGCCGCAAAGACTATTTAAAGTATATTCAGAATCAACAGGAATAA
AAGCAAGAAGACTATTTAAAGTATATTCAGAATCAACAGGAATAA |
| SEQ ID NO: 32 | ATGACCCAATTTGAAGGTTTTACCAATTTATACCAAGTTCGAAGACCCCTTCGTTTGAACTGATTCCCC
AAGGAAAAACACTCAAACATATCCAGGAGCAAGGGTTCATTGAGGAGGATAAAGCTCGCAATGACCAT
TACAAAGAGTTAAAACCAATCATTGACCCGCATCTATAAGACTTATGCTGATCAATGTCTCCAACTGGTAC
AGCTTGACTGGGAGAATCTATCTGCAGCCAATCATAGAACTCCTATCGTAAGGAAAACCGAAGAACACGA
AATGCGCTGATTGAGGAGCAACATATAAAATAGCGCATGCTGAAATCTATAAAGGACTTTTTAAGCTGGACGAT
AATCTGACAGATGCCATAAAATAGGGACCCATGCTGAAATCTATAAAGGACTATAAAGGACTTTTTAAAGCTGAACTTTTCA
ATGGAAAAGTTTTAAAGCAACCTATTTTTCCGGCTTTTATGAAACCACGACAGAACATGAAAAATGTCTTAGCGCTGAAGATAT
CAGCACGACCAATTCCCCATCGAACGTCCAGGACAATTTCCCCTAAATTTAAGGAAAAACTGCCATATTTTT
ACAAGATTGATAACCGCAGTTCGTTCTTTTCTGCGGAGCATTTTGAAAATGTCAAAAGCCATTGAATCT
TGTTAGTACGTCTATTGAAGAAGTCTTTCTTCTTTCCTTTATAATCAACTTCTAACCAAACGCAAATT
GATCTTTATATCAACTTCTGCGCCATATCTAGGAAGCAGGCACACAGAAAAATCAAGGGACTTAAT
GAAGTTCTCAATCTGCTATCCAAAAAAATGACCATAATATCCGTCCCTGCCGATCGTT
TTATTCCTCTTTTAAACAAATCTTTCTGCAAATAAATTCCATTGAATTCGAAATCGTTATCCTTGAAGAATTCAAAAGC
GATGAGGAAGTCATCCAATCCTTTTCAAATCTTCTGCAAATAAATTCCATTGATTTGACTCAATATCTTTATTTCCATAAAAGTTAG
GCAGAACATCTCTCAGCGCTTTGTACCGCCAATTGGGATACCTTGCGCAATGCCACTTTACGAAGACGGATTTC
AACCATCTCTCAGCGCTTTGTACCGCCAATTGGGATACCTTGCGCAATGCCACTTTACGAAGACGGATTTC
TGAACTCACTGGCAAAATTAACACAAAAAGTGCCAAAGAAAAAGTTCAAAGTCATTAAAACATGAGGATA
TAAATCTCCAAGAAATTATTTCTGCTGCACTTGACCCAGCCTCTTCCCACAACATTAAAAAACAGGAAGAAA
AAGAAATCTTTCCAAATCACGCTCGCTTTTAGGCCTTTATCATTCTTGTTGCTGTCGAT
GAAAGCAATGAAGTCGACCCAGAAATTCTCAGCACGCTGACAAAAAGCCCTATTCGTGTGAAAATTTAAATT
CCTTTCGTTTTATAATAAGCAAGAAAATATGCGACAAAAAGCCCTATTCGTGTGAAAATTTAAATT
GAATTTCAAATGCCAACCCTGCCTCTATTACCTTGGTATCATGCTTAAACAGAAAATGGGGCTATAAGCCCTGTCTT
TTCGTAAAAAATGGTCTCTATTACCTTGGTATCATGCTTAAACAGAAAATGGGGCTATAAGCCCTGTCTT
TTGAGCCGACAGAAAAAACATCAGAAGAGGATTCGATAAGATGTACTATGACTACTTCCCAGATGCCGCAA |

TABLE 6-continued

SEQUENCE LISTING

| SEQ ID NO: | Sequence |
|---|---|
| | AAATGATTCCTAAGTGTTCCACTCAGCTAAAGGCTGTACCGCTCATTTTCAAACTCATACCACCCCAT
TCTTCTCTCAAATAATTTCATTGAACCTCTGAAATCACCAAAGAAATTTATGACCTGAACAATCCTGAA
AAGGAGCCTAAAAAGTTTCAAACGGCTTATGCAAAAAGGCGATCAAAAAGGCTATAGAGAAGC
GCTTTGCAAATGACTTGACTTTACCGCGGATTTTCTTCTAAATATCGAAAACAACTTCAATCGATTTA
TCTTCACTCCGCCCTTCTTCGCAATATAAAGATTTAGGGGAATATTACCCGAACTGAATCCGCTTCTCT
ATCATATCTCCTTCCAACGAATTGCTGAAAAGGAAATCATGGATGCTGTAGAAACGGAAAATTGTATC
TGTTCCAAATCTACATAAGGATTTTGCCGAGGCCATACCGGGAAACCAAATCTCCACCTGTATT
GGACAGGTCTCTTCAGTCCTGAAAACCTTGCGAAAACCAGCATCCAAAACTTAATGTGTCAAGCAGAATTGT
TCTATCGACCTAAAAGCCCGATGAAGCGGATGGCCCATGCTCTTGGGAAAAATGCTGAACAAAAAC
TAAGCCATGATCTTTCCGATGAAGCAAGGCCGTCTTCCAAATGTTATCCAAAGAAGTCTCCAATGA
AATTATAAAGGATCGGCGGTTTACTTCCAGTAAATTTTCTTCCATTACACTGAATTATCAAG
CAGCCAATAGTCCCAGTAAATTCAACCAGCGTCAATGCCTACCTCTAAGGAGCATCCGAAACGCCCA
TCATTGGTATCGATCGTGGAGAACGCAATCTAATCTATATTACCGCATTGACAGTACTGGGAAATTTT
GGAGCAGCGGTTCCCCTGAATACCATCCAGCAATTGACTACCAAAAAAATGGACAACAGGGAAAAG
AGCGTGTTGCGCGCCCGTCAAGCCTCGGTCCCGTCGTCGGAACGATCAAAGACCTTAAACAAGGCTACTGT
CACAGGTCATCCATGAAATTGTAGACCTGATGATTCATTACCAAGCTGTTGTCGTCCTTGAAAACCTCAA
CTTCGGATTTAAATCAAACGGACAGGCATTGCCGAAAAGCAGTCTACCAACAATTTGAAAAGATGCT
AATAGATAAACTCAACTGTTTGGTTCTCAAAGAATATCTGCTGAGAAGTGGGAGGCGTCTTAAACCC
GTATCAACTTACAGATCAGTTCACGAGCTTTGCAAAAATGGGCACGCAAAGCGGCTTCCTTTGTATGGA
CCGGCCCCTATACCTCAAAGATTGATCCCCTGACTGGTTTTGATTTCCTGCATCCCCTTTGTAATGATGT
ATTTATCCTCCATTTAAAAATGAATCGGAAATGAAATAAACCAATTTGATGCAAAAGAAAACCTCAAGAAAAGGTG
TGGGATATTGTTTTCTGTAATCGAAAATCATCGTTTTACGGGTCGTTACGACGAAGTAATATATACCCAAATGAGGAAACAG
TCAATTGCCCTTCTGAAGAAAAGCCATTGATAGATGCCCTTGATTGCAGTGTACTCCAATGGAAGAACAG
AAATGATGATTCATGCAATTGATAGCGGAAGACTACTCACTCTCCCGTTAGGGATCGCAGTGTACTCCAAATGAACACAG
CAATGCCGCACGGGGAAGACTACATCAAGCTGCCAATGAGATGCCAATGAAAGACAAAGATCTGAAATTACAAACGGCATCAGCAGAAACTGGA
TCAGCTTCTTCTGAACCACCTCAAGAAAATGCCAATGAGATGCCAAAGAAAGACAAAGATCTGAAATTACAAACGGCATCAGCAGAACCAAGA
TTGGCCTACATTCAGGAACTGAGAAACTGA |
| SEQ ID NO: 33 | ATGGCCGTCAAATCCATCAAAGTGAAACTTCGTCTCGACCGATATGCCGAGATTCGGGCCGGTCTATGG
AACTTCATAAGGAGTCAATGCGGGGTTCGATATTACACGGAATGGCTCAGTCTTCTCGTCGATCAAGAG
AACTTGTATCGAAGAAGTCGTGCGAATGGGACGGAGAGACCAAGAATGTGACACTGTCAGAAGAATCAA
AGCCGAATTGTTGGAGCGCGTCAGGTGGGGAGCGGCGGGATCGG
ACGATGAATTGCTGCAGTTGCCGCCCTCAACTCTATGAGTTGTTGGTTCCCCAGGCGATAGGTGCGAAAG
GCGACGGCAGCAATTGCCCGCAAATTTTGACTGCGGATCGGGATCTGAGACTGCAGTTGGTGGCTTTG
GAATCGCGAAGGGGGAACAAACCCGCGGTGGGTTCGCATGCGGGGGAAACCAGGCTGGAA
GAGGAGAAGGAGAAGGCTGAACGGGCTGAAATCTCGCGATCGACTCGAGATGTTTTGCGCGCCTCGC
GGATTTTGGGTTAAAGCCACTGTAAAGCCCGTTCGACGTGGGAATGGGACATGTTCCAACAAGCATCGAACGGATGAT
GTCGTGGGAGTCGTGAAGTCGAATCAGCGCGTTGGGCAAGAGTACGCGAAACTCAATCAGTTGCAACAAGATATGA
TTGAGCAGAAGAATTCGTCGCGACTATTTGAAGAAGTGGGGGAACATCGCGCACTATGTGACCACCTTTCGATTTGTACGACGCC
AAGAGCATCGGACAAGGTATTTGAAGAAGTGGGGAACGTAACACGGAGAAACTCGCCCCGATGCACATCACATGTGTTCGCAAAATTGCA
GAAATCAAGAATGTGCAGAGACGTAACACGAGACGATTCGGATTCCGTTTCTCACGCGTTACGCGTGTACACAC
GAGCCAGAGATATCAGCCTGCGGGCAAAGCCCGTTCGGAAGTGTTCGGACGTTTACGTGGCGGATTATGCACAGC
ATCCTTCGCAAACTGAATCACGCCAAAATGTTCGCGACGTTTACTTTGCCGATGCAACGGCCACCCG |

TABLE 6-continued

SEQUENCE LISTING

| SEQ ID NO: | Sequence |
|---|---|
| | ATTTGGACTCGCTTCGATAAATTGGTGGGAATTGCACCAGTACACCTTTTGTTCAACGAATTTGGAG<br>AACGCAGGACGCGATTCGTTTCAACGCTATTGAAAGTCGACAATGTGTCCAAGAGAAGTTGATG<br>AGTCACCGTGCCCATTTCGAGATTACGAGAGCCGAACAGCATTTCACAGGTGAATTTGTGGCGCAAGATCCA<br>TGCGCTATATTTCGAGATTACGAGAGCCGAACAGCATTTCACAGGTGAATTTGTGGCGCAAGATCCA<br>GTCCGCCCGGGATCAGCTGCTCATATGCACCGACGCAGAGGGCGAGGGATGTTATCTCAATGTCAG<br>CGTACGTGTCGAGAGTCAGTTCGAGGCGCCGTTGTCCATTTCGATAACTATCGGATTATCTGCGAACATCGGAT<br>GGTCGGGACAACCATCGCGCCGTTTGTCATTTCGATAACTATCGGATTATCTGCGAACATCGGAT<br>GATGGGAAGCTCGGGTCGAGGGGTTGCTTTCCGGCTGCGGGTGATGAGTGTCGATCTCGGCCTTCGC<br>ACATCTGCATCGATTTCCGTTTTCGGTTTTCGCCTGGAAGGACGAGTTGAAGCCGAACTCAAAAGTCGTG<br>TACCCGTTTTCTTTCCGATAAAAGGAATGACAATTCGTCCGCCGTTCATGAGCGATCACAACTCTTGAA<br>GCTGCCTGGCGAAACGAGTCGAAGGAGCCGTGCTATCCGACAAGACGCCAACGGACATTGCGGC<br>AGTTGCGACCAACTGGCCTATTTGCGGCTGCTCGTGCCGTGTGGGTCCGAGAGTGTGGGCGCGGTG<br>AACGGAGTTGGGCAAAGCTTATCGAGCAGCCGGTGATGCGGCCAATCACATGACACCGATTGCGC<br>GAGGCTTTTGAAAACGAACTTCAGAAGCTTAAGTCACTCCATGGTATCCTGAGCGACAAGGAATGATG<br>GATGCTGTCTACGAGAGCGTTCGCCGGTGCACATGGCAAACGGTTCGCGATTGGCGAAAG<br>GACGTACGAAGCGGAGCGCGGCCCAAGATTCGCGGCTATCGCAAAGACGTGGTCGTGGAAACTTCGAT<br>TGAGCCAAATCGAGTATCTGCGCGAGAAGGGATCCGTTTTGCGATCACGCTCGCGCAACATTGATCACGC<br>GGGACAAGTGATTCGTGCGAGAAGGATCTCGTTTTGCGATCACGCTCGCGCAACATTGATCACGC<br>CGTTCTCGTCCGATTCGACGCCGGCAACTGGGACTCCGCTCATCATTATGGAGGCTTCTCGGATGTGTACGCGTT<br>CACCCAGGAGCACACATTCAGAACCATTTCCTTGGTGGCTGAACAAGTTTGTGGTGAACATACGTTGA<br>TGCTTGTCCCCTACGCGCAGAGACCTCATCCCAACGGTGAAGGAGAGATTTTCTCCGCCGTTCAGC<br>GCGAGGAGGGGGACTTTCATCAGATTCACGCCGACTCGAATGCGGCCGAAATCGCAGCAGCACTC<br>TGGTCTGATTTGATATCGATCAGGCTTCAAATTCGTTGCGGTGTGATTGGGGTGAAGTGGAACTCGTTC<br>TGATCCAAGGCTTACAGGAAAAACAACGCGATTCATATAGCACAAGCTGTTTTATCATACAG<br>GTGTCACCTATTATGAGCGAGACGAGGAAGCCGAGGAAGGTTTTCGCCAAGAGAAATTGTCG<br>GAAGAAGAGCGAGTTGCTCGTGAAGCAGACGAGGCGAGGAGAAATCGGTCGTTTTGATGCGTGA<br>TCCGTCGGCATCATCAATCGGGAGAATTGGACCAGGCAAAAGGAAATTTGGTCGATGGTGAACCAGCG<br>GATCAAGGATACTTGGTCAAGCAGATTCGCTCGCGCGTTCCATTACAAGATAGTGCGTGTGAAAACAC<br>GGGGGATATTTAA |
| SEQ ID NO: 34 | ATGGCGACACGCAGTTTATTTAAAATTGAACCAAATGAAGAAGTTAAAGGGATTAAAGGGACG<br>CATGAAGTATGAATCATGAAATGTCCTACTACATGAATATCTGAACCATATTAGACAAGGAAGCTATTT<br>ATGAACATCATGAACAAGATTCCTAAAAATCCGAAAAAAGTTCAAAAGCAGAAATACAAGCCGAGTTA<br>TGGGATTTTGTTTTAAAATGCAAAAATGTAATAGTTTTACACATGAAGTTGACAAAGATGTGTTTTTTA<br>ACATCCTGCCGTAACTATATGAAAGATTTGATCCCCTAGTTCAGTCGAACAAGTCAAAGTGGGACCATCCGAGATCCG<br>TATCCAATAAGTTCTGTACCCGCTAGTTGATCGAACAGTCAAAGTGGGACGCCATCATCCG<br>GACGTAAAACCTCGGTCGGTATAATTTAAAATAGCAGGCGACCCATCGTGGGAGAAGAAATAGAAGAAA<br>TGGGAAGAGGATAAAAAGAAGATCCCTTGCTAAAATGTAAAATGTAAAAGAAATTAAATGGATGGAAAAAGT<br>CGTAATCAAAGTCGTCCGCGACTTGATAAGGATATGTTTATCCAGCCATTAGAGCGTTTCTTTCATGGA<br>AAAGTTGGAACCTTAAAGTAAGGAAGAGTATGAAATCCCTTGAACAATATGAAAAGGAACAACAAACACTAGAGA<br>AAGGATAAAAGAGGACATTCAAGCATTAATGATGAAATGAACAATATGAAAAGGAACAACAAACACTAGAGA<br>TTCTTAGAGATACATTGAATACAAATGAAATACCGATTAAGCAACAAGAGGATTACGTGGTTGGCGTGAAA<br>TTATCCAAAAATGCTAAAGATGATGAAATGAACCATCAGAAAATATTTAGAAGTATTTAAAGATT<br>ATCAACGAAACATCCACCGAGAAGCCGGGACTATTCTGTCTATGAATTTCTGTATGAATTTTAAGCAAGAAAAGAAATC |

TABLE 6-continued

SEQUENCE LISTING

| SEQ ID NO: | Sequence |
|---|---|
| | ATTTTATTTGGCGAAATCATCCTGAATATCCTTATTTGTATGCTACATTTGTGAAATTGACAAAAAAA<br>GAAAGACGCTAAGCACAGCAACTTTACTTTGGCTGACCCGATTAACCATCCGTTATGGGTACGATTT<br>GAAGAAGAGCGGTTCGAACTTAAACAAATATCGAATTTAACAGAGCAATTACACACTGAAAAGTTA<br>AAAAAGAAATTAACAGTTCAACTTGATCGTTTAATTTATTCCAACTGAATTCCGGCGGTTGGGAGGAAAAA<br>GGTAAAGTAGATATCGTTTTGTTGCCGTCAAGACAATTTATAATCAAATCTTCCTTGATATAGAAGAA<br>AGGGGAAACATGCTTTTGACCGTACAGTATCCGTGGAGATATCTTAAAATTCCCCTAAAGGTAACTTGGTGGTGC<br>AAGAGTGCAGTTTGACCTGACCATTTGCGCACAGTTTGATCGAGAATAGAACCAAGTAGAAATGTTGACG<br>GATTTATTTTAACATGACAGTAAAATATTGAACCAACTGAGAGCCCTGTTAGTAAGTCTTTGAAATACAT<br>AGGGACGATTTCCCCAAGTTCGTTAATTTTAAACGAAAGAGCTCACCGAATGGATAAAGATAGTAAA<br>GGGAAAAAATTAAAAAGTGGTATAGAATCCTTGAAGATTGGTCTACGGGTGATGAGTATCGACTTAGT<br>CAACGTCAAGCGCTGCTGACAACGAAAATAGTAGTTGATCAGAACCGGATATTGAAGGAAGTTA<br>TTTTTTCCAATCAAAGGAACTGAGCTTTATGCTGTTCACCGGCAAGTTTTAACATTAAATTACCGGGTG<br>AAACATTAGTAAAATCACGGAAGTATTGCGAAAGCTCGGGAGGACAACTTAAATTAATGAATCAA<br>AAGTAAACTTCTAAGAAATGTCTACATTTCCAACAGTTTGAAGATATCACAGAAAGAGAAGCGT<br>GTAACTAAATGAGTTCTAGACAAGAAAATAGTGATGTTCCTCTGTATATCAAGAGAGCTAATTCAAA<br>TTCGTGAATTAATGTATAAACCTATAAAGAGATTGGGTTGCCTTTTTAAAACAACTCCATAAACGGCTAGA<br>AGTCGAGATTGGCAAAGAGGTTAAGCATTGGCGAAAATCATTAAGTGACGGGAGAAAGGTCTTTACG<br>GAATCTCCCTAAAAAATATTGATCGAACAAGGAAATTCCTTTTAAGATGAAGCTTACGTC<br>CAACGAACCTGGGAAGTAAGACCGTTGAAGTAAGACCGTTTTGCATTGATCAATTAAACCACC<br>TAAATGCATTAAAAGAAGATCGATTAAAAAGAATCGGAAAGATCCAAATACGATTATCATGCAAAAATCGGCTAGA<br>GTTATGATGTAAGAAGAAAAGTGCAGGCAAAAGGTCCCGTTTGAAACTCAAACTGATGAAGTGGTCACGGA<br>TATCTAACTACACAATCCTTACGAGGAAAGGCTCCCGTTTGAAACTCAAACTGATGAAGTGGTCACGGA<br>GAGAAATTCCACGACAAGTCGCCTTACAAGCTGAAATTTACGAGGTGAAATTGGGGAAGTAGTGCCC<br>AATTCAGTTCAAGATTCAATGCGAAAACCGGGTCGCCGGAAATTCGTTGCAGTGTTGTAACGAAAGAA<br>AATTGCAGATAATCGCTTTTTAAAAATTGCCTTATATCCAGATAAGAGACGACTTACTCTTGATAAAATCGCAG<br>TTTAAAAGAGGAGACTTATATCCAGATAAAGGTGGAGAAAAGTTTATTCTTTATCAAGGATCGAA<br>AGTTGGTAACTACGCATGCTGATATTAACGCGCTATCAGTTGATGACAAGTGGATTATTCTCGGAGACAA<br>ATGAGATTTTATAAAGTTACTGCAAGCGAATTTGATTTTCCGAAGGGAGTATTTTTTGCAAATTAGA<br>GGACCAAAAACAAAAATAATTGAAGAATTAAAAAAGGTTCCTCTAAACAATCATCGAGTGAATTATAGA<br>ATGGGTAATGCGGGAAACTATTCATTTGATTTGATTGCAAGTGAACTTAAGGGAGGAAACTCATGTTATATCG<br>TTCGGACATACTGAAAGATATTCCTTCCGACAAGTGGATGGCACGAGGAGTATTTTGCAAATTAGA<br>AGATCCGAGTGAAACGTATTTCTCCGACAAGTTGGATGCCCACGAGGAGTATTTTTGCAAATTAGA<br>AAGAATATTGATTTCTAAGTTAACAATCAATACTCAATATGAAGATGATTCTTCAAAACA<br>ATCAATGTAA |
| SEQ ID NO: 35 | ATGCCCACCCGCACATCAATCTGAAACTTGTTCTTGGGAAAAATCCTGAAAACGCAACATTGCGACGC<br>GCCCTATTTTCGACACACCGTTGGTTAACCAAGCGACGAAACGTATTGAGGAATTCTTGTTGCTGTGTC<br>GTGAGAAGCCTACAGAACGAGTGGATAATGAGGGGAAGAAGCCGAGATTCCACGTCATGCAGTCCAA<br>GAAGAAGCTCTTGCCTTTGCCAAGCTGCTCAACGCGCTGTATATCCACCTATGAAGACAA<br>GAGATTCTTGATGTACTGCGAACGTCTTTGTCTTTGCGTCAACGAAAACAACGAGGCA<br>GGCGATGCTCAAGCTGCTAACGCCCTGGTCAGTCCGCTCATGTCGCAGAAAGCCAAGGAGGCTTGTCG<br>GTCTACGACAAGGTGCTTGATCCACCCGCCGGTTTGGATGAGGGACAAGTGCTTACTTAATAGCCAGGATGG<br>CCCCGCTGGATTCCAAATTTGGATTCGGGCAAGCTGGCAAGATGCAAGATGATTCGTCAGTGACCAAAGAAA<br>AAGCAAGATGAGCTGACCAAAGGGACGCACCACTTATAAAACAACTCAAAGAAATGGGTTGTGCC<br>TCTTGTTAACCCATTTTTAGACATCTTCTTGACCCTGAAGGTAAAGCGTGAGTCATGGGACCCGTCTT<br>GCTGTACGGCCTGCAGTGGCTCACTTTATCTCGGAAGTTGAATCATAGAACACGTGCAGAATAC<br>AATTCCTTGAAACATCGGCAGACAGAGTTGAGGCAGCATCCGACGAATTCAAAGACGATTTACTTTG<br>CTCCGACAATGAAGCCAAACGCCATAGTACATTGAAAAGCATCGCGCTGGCCGACGATTCGAACCCT |

TABLE 6-continued

SEQUENCE LISTING

| SEQ ID NO: | Sequence |
|---|---|
|  | TACCGGATTGGAGTACGTTCTCTGCGTCCTGCGAACCGCGTTCGTTGAAGAATGGATAGACAAGGGTGCA<br>ACAGAAGAACCAACCGCGTGACCATATTGTCAAAGCTTCAAAGCTTCGGGGAAAAATTCGGCGATCCC<br>GATCTGTTCAACTGGCTAGCTCAGGATAGGCATGTCCATTTGTGCTCTCCGGACAGCGTGACACCAT<br>TGGTTCGCATCAATGCGGTAGATAAAGTTCGCGTCGACGAAACCGTATGCATTGATGACCTTTGCCCA<br>TCCCCGGCTTCCACCCTGCGATGGATACTGTACGAGGCTCCAGGAGGAAGCAATCTCCGTCAATATGCATTG<br>GATT GTACAGAAAACGCTCTACACATCACGTTGCTTGCTTTGCTTGTCGACGATGCGCACGAACCTGGATTG<br>AAAAAAGATCAGGGTGCCGCTGGCACATCCGGACAAATTCAAGATTTAACTCTGGAAAAACTTGAGA<br>AGAAAAAAATCGTTTATACTACCCGTTCCGGTTTTCAGCAGTTGCCGCTGGCTGGCCGGAGCTGAAGT<br>TCTTTTCCACAGACCCTATATGGAACACGACGACGCACCAGGCTCCCCCCGAGAGTCTCTTTTGGAACGTCCGGGAGC<br>CGTTTGGTTCAAATTGACCCTGGATGTGGCAACACAGGCTCCCCCGAACTGGCTTGATGGTAAGGGCCG<br>TGTCCGTACAACCGCCGGAGTGACATCATTTAAACCGGTCTGCGAATAAAAGCAAAACATACACGTAC<br>GCTGCAGCCGGGTCTCCGTCTTCTGTCAGTAGACGTTGGGCATGCGAACATTCGCCTCTCCTCAGTATTT<br>GAACTCATGCAGGGAAAGCCTGAGACAGGCCGTGCCTTCCCTGTTGCCGATGAGAGATCAATGACAGC<br>CCGAATAAACTGTGGGCCAAGCATGAACGTAGTTTTAAACTGACGCTCCCCGGCGAAACCCCTTCTGA<br>AAGGAGAAGAGAGCGTAGCATACAAGAGGCGAAATTTATGCACTGAACATACCTGCACATACAACGCCT<br>CAAAAGCCTACTCCCCTTAGGTGAAGAAGATAACCGATAACCGTCCTGATCGATTCGTTGAACAGTTCTTT<br>AAAGGATGGGGAGAAGAAGACGTTGTGCCTGGACAAGCGTTTCCACGCTCTCTTTTTCCAAGGGTTGGGA<br>GCTGCCCCGTTTCGCTCAACTCCAGAGTTATGGCGTCAGCATTGCCAAACATATTATGACAAGCGGAA<br>GCTGTCTCTGCTAAACATATCAGTGATTGGCGCAAGCGAACTCGTCCCCGTCCAAGATCGCGGGAGATG<br>TGGTACAAAACACGTTCCTATCATGCGGCAAGTCCATTTGGATGTTGGAATATCTTGATGCCGTTCGAA<br>AACTGCTTCTCAGTTGGAGCTTACGGTGCTGTCTACTTACGGTGCCATTAATCGCCAGGATACAGCCCGGTT<br>TGGTTCTTTGGCATCACGGCTGCTCACCATATCAATTCCCTAAAGGAAGACCGCATCAAAACAGGAGC<br>CGACTCTATCGTCAGGCTGCTCGCGGTATATCCTCCGGAGGGTTGGGAACACAAAGATAT<br>GAGCCTTTCTTTGGAGCCCTGCAGCAGCTTGAAAATGGACAAGGAGCTTTCGAGTTGGTTCGAGACATG<br>AGAACAGCCAACTCATGCAGTGGAACCATCGAGCCATCTGGCAGAACAACATGCAAGCCGAACTC<br>GGTGTACGTTGTCGTTTTCTTCTAGAAGAGACTTGATAAGGATTTGCCCAACGATTTCGCCAACCGTACCTTCTCAGGG<br>AACTTTCTTGATGCTCGGCAATACAAAAGTCGAGTCTGAAGAAGAACAGTTCGCTTCATTGCTGTCTGCAA<br>AAATCAGGCCAGGCAGTCTTGTTCTTCCTTGGGATGGAGGCGAACAGTTCGCTACCCTGCATCCCAAAGAC<br>AAACACTTTGCGTCATTCATGCCGATATGAATGCTGCCCAAAATTTACAACGCCGGTTTTCGGTCGATG<br>CGGCAGGCCTTTCGGCTTGTTGTCAACCCACCGTGACAGCTGTACGACTCGCATCCACCCCAGGA<br>GCTCGTCTTCTTTGGAGCCCTGCAGCAGCTTGAAAATGGACAAGGAGCTTTCGAGTTGGTTCGAGACATG<br>GGGTCAACAAGTCAAATGAACCGGTTCGTCATGAAGTCTTTGGGAAAAAAGAAAAATAAAACCCCTTCAG<br>GACAACAATGGAGACGCAGAGCTTGAAGACGTGTTGTCCGTACTCTGCCAACGTCTGGATACCCGGCCAAACAGTTTT<br>TATCACAGTCTCCCGATTCATCAGGAATCTTTTTTCCTTGCAACGTCATGGCTTCCCATTCTTTGGGGTGA<br>GGCCAGTACGCCCATGATTTGGAAGGTCATGCTTCCCATTCTTTGGGGTGA |
| SEQ ID NO: 36 | ATGACAAAGTTAAGACACCGACAGAAAAATTAACACACGACTGGGCTGCTCCAAAAGAGGGAAGT<br>ATTAGGCTCAAATGGCAAGCTTCAGAATCCGTTGTTAATGCCGGTTAAAAAGGTTCAGGTTACTGAGTT<br>CCGGAAAGCGTTTTCTGCGTATGCTCGCGACGAAAGGACGAAATGACTGACCGGCCGAAAGAAATATGTT<br>TACGCATAGTTTCGAGCCATTTAAGACAAAGCCCCTGCTCCTGCTTCATCAGTGTCAGATAAAGCATAT<br>CAATCTTTACATTCGTATCTGCCCTGTTCTCCTTGCTCATTTTCTATTATCGCTCACGCATTAGGTTTTCGT<br>ATTTTTTCAAATTGGTGAAGCAATCTCAGGCATCCTCAAAATTGAAGCTTACGAATCAAAAT<br>TGGCCAGCGAATTAGCTTGTGTAGATTTATTCAAACTTGACTATTCAAAACTGCTTTTAATGCGCTT<br>ACAACGTCTGTAAGAGGGCTCGTCTGAGACACTCAAGGGCTGAAGAACTAGCGCTGACTTTACCACTTA<br>CTTACTGGCAAGCCTCTGTCTCGAGACACTCAAGGGCTGAAGAACTAGCAGAAGTTATCTCGCGTA<br>AGATAGCTAGTTCTTTTGGCACATGGAGCACATGAAAGAAATGACGGCAAACCCTCTTCAGTCATTACAATTTTTGA<br>GATTGCAGGGACTTAAAAAATGAACCATTGTTTTGATCCTGACGCCCTGTTTTGAATATAACG |

TABLE 6-continued

SEQUENCE LISTING

| SEQ ID NO: | Sequence |
|---|---|
| | CAGAGAGACCCTGCCGACATATTAATTAACTTACAGCTCGTTAGCTGTTAAGAAGCTGTCATCAAAAATC<br>AAAACGTAGGAAATTACGTTAAAAACGCTATTACTGACCACCACAAATGCCAATGGTCTTGGTTGGCTTTGA<br>ACAAAGGTTTGTCGTTACTCCCTGCTTAATTGAATTGATTGCACAATTAGAAGCCCCGAGCTCTTTGAACGATC<br>TCATCCCTACCATGCCATGCCTTAATTGAATTGATTGCACAATTAGAAGCCCCGAGCTCTTTGAGAAGAAC<br>GTATTTCAGATACTCGTTCGAAGTTCAAGGTATGATTCAGCTGTTTCTAATCATATTGCTCGTCT<br>TTCCAGCTCTAGAAATAGCTTGTCAATGGATAGTGAAGAATTAGAACGTTTAATCAAAAGCTTTCAGAT<br>ACACACACCTCATTGCTCACTTTTATTGCGCCAATCACTTTCACGAGTTAGAATCTTTGCCTGAA<br>GCCCTTCAATCGGGCGTTAATTCAGCCGATATTTTACTAGGCTCTACTCAATATATGCTCACCAATTCTTT<br>GGTTGAAGAGTCAATTGCAACTTATCAAGAACACTTAATCGCATCAATTACTTGTCAGGTGTTGCAGGT<br>CAGATTAACGGCGCAATAAAGCGATAGATGGAGAAAAAATTCACTTGCCTGCAGCTTGGTC<br>AGAGTTGATATCTTTACCATTATAGGCCAGCCTGTTATAGAGTGTGAAAGCGATTAGCTCATCTAAAA<br>AATCAATAACCAAACACTTTCAAATGAGTTTGATACTCTTATATCTGCTTTGCAAAGAATTTGATTTGA<br>ACTTTAATAAAGCGCTCCTTAATCGTACTCAGCATTTGAAGCCATGTGTAGAAGCACTAAGAAAAACG<br>CTTTATCCAAACCAGAGATCGTTCCTATCGCGACCTGCTCGATTAACTTCTTGTTTGTATCGAGGC<br>TCTTTAGTTTTGCGTGCGTGCCGACATTGAAGTGTTAAAAAACATAAAAATATTTGAGTCAAACAGCGAAC<br>TTCGTGAACATGTTCATGAAAGACATTTCGTTGTTAGTCTCTAGATGCCAAAGCCAAGATAATCTT<br>CCTTCGATTAACTGATTCGGCTCCAGACTTGTTTACATGTTATTGATGAAATATTGCAGCACGATAATTCTT<br>GAAAACAAAGACCCGAGTCACTTTGGCTACTTCGTTGTTACTCTTGGTTATTTGCTTGCAGGACTTCCAGATCAAC<br>TTTCTTCATCTTTTATTAACTGCCTATCATCACTTCAAAAAGAGATAGACGCCTTATAGACCTGATTCAG<br>TATGATCAAATTAATCGTGATGCTTTGTTTATGTTAGTGACCTGCATTCAAGTCTAATTGTCTGGTCT<br>GCAGTATCGTGCCAATAAGCAATCGTTCGTGTTACTCGCACGTAAGCCCTTATCTCGGCTCAAACTT<br>GTCTACGTACCCAAGGATAAAGATTGGTTAGTTCCTTCAAATGTTTGAAGGACGATTGCTGACATTC<br>TTCAATCAGATTATATGGCTCGAAAGATCTGAAGATTCGCTGTGTAATTGATACTGCAAAAACACCTTTC<br>TAATATAAAGAAGTCTGTATTCATCCGAAGAAGTCTCGCTTTTAAGAGAACTCCTCACCGCACA<br>TTTATCCAGACCGAAGTTCGCGGCCTTGGCCTTAATGTCGATGGAATTGCATTTAATAATGGTGATATTC<br>CGTCATTAAAACCCTTTCAAATTCGTTCAGGTGAAAGTTCTCCTCCGAGCATTCAATTGAACGGCGCTATTATAAA<br>ACTTAATCGTTGCTTTTCTGGCTCTCCAGGTTTCTCCTATGGTAATTCCAACGTTGCTCTTGCTGCGGTGC<br>AAAGACGATCAAATTCATGAACGACCAGCAGAAACAAGATACGATTCCAGATGCCCGAACTGAGTT<br>GGTTCATGCTTCTGACGATGCGGGTGGACACCCAAGTTATTTGCTCGGCATTGATCCTGGCGAGTATGGA<br>ATGGGTCTTTTCATTGGTTTCAAAAGAGCAACCATCAAACTAAGGTTGTTCCGCGCAGCAGTACAAATCTCCT<br>GATCAATTTTGCCTCTAAAAAGAGCAACCATCAAACTAAGGTTGTTCCGCGCAGCAGTACAAATCTCCT<br>TATGACAAATTATTTAGAACAATCTAAAGATCTGCTGGTGATATTCGCATATACTCGATGACTTA<br>TATACAAATTAAATGCGTTGCCTGTTTTGAGGCTCTTCAGGTAATTCTCAGAGTGCTGCTGATCAAGTT<br>TGGACGAAAGTCTTATCGTTTACACTTGGGGTGATAATGACGCTCAGAATTCATTAGAAAGCAGCATT<br>GGTTTGGAGCCAGTCATTGGGATATCAAAGTATGTTAAGGCAACCCCTACGGAGAAGAAGCCTAAAC<br>CGTATATTGCTTTTCCTGGCTCTCAGGTTTCTCCTATGGTAATTCCCAACGTTGCTCTTGCTGCGGTGC<br>AATCCTATTGCAACAACCTTTTGACCGACAACTTGCAAAGGCAAAGGATAACCTCTATTAAAGAGCTAAAATTCGCAATTCT<br>GAGATACAGCTTTTTGACCGACAACCATTAAATTATTTATTAATCCAGACCATCCACTGTGATAGAGAAGG<br>CGAATAATCTTGGTCCATCAAGAATTCCTGTTGCTGACCGTACTTTCAAAAACATCAGTCCATCAAGTC<br>TAGAATTTAAAGAATTATTTGAATTACTATCCGTGTCTCGATCTATCCGTCATTCACCTGAGTTATCGCTAAAA<br>ACGCGGCATAGGGTCTGAGTATTTTGCGCTATTCGCAACTCATCCTTAAATTCGAAGCTAAC<br>GCAGCTGCTAACGTAGCCGCAAATTCAAAACAGTATTTTTTGAGTTATAA |
| SEQ ID NO: 37 | ATGAAGAGAATTCTGAACAGTTCTGAAAGTTGCTGCCTTGAGACTTCTGTTTCGAGGCAAGGTTCTGAAT<br>TAGTGAAGACAGTCAAATATCCATTGGTTTCCCCGGTTCAAGGCGCGGTTGAAGAACTTGCTGAAGCAA<br>TTCGGCACGACAACCTGCACCCTTTTGGCAGAAGGAAATAGTGGATCTTATGGAAGAAGACGAAGGAA<br>CCCAGGTGTATTCGTTGTGATTTTGGTTGGATACCCTGCGTTTAGGGATGTTTTTCACCATCAGCG<br>AATGCGTTGAAAATCACGCTGGGAAAATTCAATTCGAACGTTGAAGTTCACCTTTTCGAGC<br>AGTCACCTTTTTTTTCTGCGGGTCGACTAGCCAAGATAGGATTGAACCTGCCGAAGGATACTTTCTGTTGAAATCAG |

TABLE 6-continued

SEQUENCE LISTING

| SEQ ID NO: | Sequence |
|---|---|
| | AAAGATTGGTAAAAGAGAAAACAGAGTTGAGAACTATGCCGCCGATGTGAGACATGCTTCATTGGTCA<br>GCTTTCTTCAGATGAGAAACAGAGTATCCAGAAGCTGCAAATGATATCTGGAGTAGCAAGGATCATGA<br>GGAACAGAGAATGTTGAAGGCGGATTTTTTGCTATACCTCTTATAAAAGACCCCAAAGCTGTCACAGA<br>AGAAGATCCTGAAAATGAAACGGCGGGAAAACAGAAACCGCTTGAATTATGTGTTGTCTTGTTCCTGA<br>GTTGTATACCCGAAGTTTCGGCTCCATTGCTGATTTTCTGTTGCAGCGACTTACCTTGCTGCGTGACAAA<br>ATGAGTACCGACACGGCGAAGATTGCCTCGAGTATGTTGGCATTGAAGGAAGAAAAAGGCAATGCAAT<br>GAATTCCTGCTCGCGCACTTTTTGAAGACCTCGAGGTGATGTTTTGAACAGATTTTCAGTTTATGC<br>TTGGGTCTTATGTTGCTGGCAGGGGAAGGAAGATGTACTGCGCCGAACGATTGGATTTGCTGGCCGAAA<br>AAGTCAAAAGATTACCAAAGCCAAAATTTGCCGGAGAATGGAGTGGTCATCGTATGTTTCTCCATGGTC<br>AGCTCAAAAGCTGGTCGTCGAATTTCTTCCGTCTTTTTTAATGAGACGCGGGAACTTCTGAAAGTATCAA<br>GAGTGATATTCAACATGCCACCATGCTCATTAGCTATGTGAAGAAGAAGAGGCTATCATCCACAGCT<br>GTTGAGTCAGTATCCGAAGTTAATGGAACAATTACCGGCGTGCCGACTAAGGTTTTGGATCCTCGAGAT<br>TGAGATGACGACATATGTCCGAGGCTGTTCGAAGTTACATTATGATACACAAGTCTGTAGCGGGATTTCTG<br>CCGGATTTACTCGACTCTTTGGATCGGAGATAAGGATAGGGAATTTTTGCTTCCATCTTTCCTCGTATTCC<br>AAAGATAGAATAAGAAGAAGAAGAACGTGTGCATGGAGCTACCCGGCCAGCCAGGAAGGCTATT<br>TGTTCACAGCAACAACCTTTCCGAATTTTCTTGAGAATCCGAAACATGTGCCACGATTTATGGCAGA<br>GAGGATTCCCGAGGATTGGACGCGTTTGCGCTCGGCCCTGCGCCCTTTATCAGTTCAATGAAAGTTTTTGCGT<br>GCAAGAAGGTGGTGAATCAGTTGGTTGAATCTGCCAGGCGCCCTTTATCAGTTCAATGAAAGTTTTTGCGT<br>CAAAGACTGCAAGCAATGCTTACGGTCTATAAGCGGATCTCAGACTGAGAAGTTTCTGAAGCTGCTG<br>GCTGATGTCTGTCGTCCACTCGTTGATTTTTCGGACTTGGAGGAAATGATATTATCTTCAAGTCATGTCA<br>GGATCCAAGAAAGCAATGGCAGAGATCTATTCCACTCAGTGTCCCAGCGGATGTTTATACAGCATGTGA<br>AGGCTTGGCTATTCGTCCGCGAGAACTCTTGGATTTCGATTGGAATAAATCTGAAAGGACACGAGCGGGA<br>AGATTTTTACGGCTGCATCAGTTGCTGCAGGGGATCTCGAGTCTGTTGCTGTGATCGGATGCGAAACTTGTCGTG<br>AAGCTGAAGACTGATGAACAATCTCTGTTCAGGAGTATGTGAAGCACGAAAAGCCATTGATCTT<br>CCCTTGGAGATTTTCTGAGGCGTAGTTGAGGTGCCGATTTCTCAATGGCTATCTCTTTTCGAACTGCGCCAGCT<br>GAATTGTTGCTGAGGCGTAAGTCGGTGATGAGGTCTTACAGCCTCAAAACGACAGGCTCGCCAAATAG<br>GCTCTTCCAGTGGTTACCTACCGGTTGTCCGCTCTTTTCTGGATCTTACGCTGATGCATTGCTGGCA<br>GAGCGCCTCGATACACCTACGGTTGTCCGCTCTTTTCTGGATCTTACGCTGATGCATTGCTGGCA<br>AACTCTTGACGGATCCGGTAAACTGCCGGCGATGAGTAACATCCAGGATCCTCTTCCAAATGGTGGTTCTGGC<br>CAAGTTGCCTGTAAACTGCCGGCGATGAGTAACATCCAGGATCCTTCCAAATGGTGGTTCTGGC<br>AAAACCAAAGAAGGGTGTTGCTAGTAACGCTTGGATGCTTGAACCTATTCCCCGATCCTGCTCATCCTGTTC<br>CGGGTGAAGAGTTCCTGGCCGAGTTGAAGTAACCTGGAGGGGTTGTTGTATCTCCGAAGATACACCA<br>CTGACCATTGAACTGGCCGAAACGTCGGTCAGTTGCGTCAGTTGAATGGATCAACTTTCAGTCCCTTTCGATTTGAAGA<br>ATCTGACGACTATCTGGGTCGTGTTGGTGAATTCAGGGTGACGGCAGATCAACCTTTCAAGCTGACGCC<br>CATTATTCCTGAGAAAGAGAATCTTTCATCGGAGAGACCTACCTCGGTCTTGATGCTGGAGAGCGATC<br>TGGCGTTGGTTTCGCGATTGGACGGTATGCCGCATGGGTATGAGGGTGCAGGGTGGGTGTGCATGA<br>AGATACTCAGCTTATGGCGCTTCAGCAGGCGCTTCAGCAAGTCGCCAGCAAGTCTCTTAAGGAGCCCGGTTTTCCAGCCACTC<br>CGTAAGGGCACATTTTCGTCAGCAGGAGCGCATTGCAAAAGCCTCCGCGGTTGCTACTGGAATTTCTATC<br>ATGCATTGATGATCAAGTCACCGAGCTAAAGTTGTCATGGAATCGGTTGGGTTCATCCGGTTCGGTGG<br>GGCAGGTGCGTGCATTTCAGAAGAGTCATTTCAAAAAGGCTGATGTTCTGCCAAGAAGGTGAAAAA<br>ATGGTGTAGACAAAAAAAAGAGAGAAAGAGCGCTCAGGATACCTTCAGGATGGGGAGGAGCTTTCTCGAAG<br>AAGGAAGAGCAGCAGATAGCCTTTGAGGTTCAGGCAGCTGGATCAAGCCAGTTTTGTCTGAAGTGTGGT<br>TGGTGGTTTCAGTTGGGGATGGGAGTAAATCTGTGCAGGAGATGGCGTGGCGTGGACTGGAAC<br>CGGTCCATTGTAACCTTCCTCATCGAATCCTCAGGAGAAAGGTATATGGTTTCAGTCCTCAGCAACTGG<br>AAAAAGGCTTTCGTCCTGACATCGAAACGTTCAAAAAAATGGTAAGGAGTTTATGAGACCCCATGT<br>TTGATCGCAAAGGTCGGCCCGCCAGTCGCGCTATGAAGAATTCGTACTGGACGTCGTCACCGTCGTTATC<br>GCTTTGATAAAGTTTGAAGAGAGATTTGGTCGCAGTGCTCTTTTCATCTGCCCGGGGTCGGGTGTG<br>GAATTCGATCACTCCAGTGAGCAGTCAGCCGTTGTCCTTGCCCTTATGTTACATTGCTACATTGCTGATAAGGAA |

TABLE 6-continued

SEQUENCE LISTING

| SEQ ID NO: | Sequence |
|---|---|
| | GGGATGAGTGGTAAGAAGCTTGTTTATGTGAGGCTGGCTGAACTTATGCTGAGTGAGTGAAGCTGAAGAAA<br>CTGGAGAGATCAAGGGTCAAGAGAACAGAGCTCGGCACAATAA |
| SEQ ID NO: 38 | ATGCAGAAGAAGCAAGCAGATGCAATGCGCAAGTGCGCGCAAGTCGGGCGCAAGCATGAAGTATGAAGTAATTGGATT<br>GGGCAAGAAGTCATGCAGATCAGTATATGTGCCCAGATTGCGCAATGCAAGCCAGAGCCAAGCGCCAAGATTCAGA<br>ACAAGAAAAAGCGCAACAAAAAGTATGGATCCGACCGAAGAGGCCAGAGCCAGAGGATAGCTGTGGCT<br>GGCGCGCTTATCCAGACACAAAAGTTCAGACAATTAAAGACCTACAAATACCCAGCGGATCTTAATGGC<br>GAAGTTCATGACAGCGGCGTCGCAGAGAAGATTGCTTCACAAAAACAGAGCGAGCCGTATTCAGTTGTAGAT<br>GGCCGTCCAGCGAATACGCTTGCTGGATTGTCTCACAAAAACAGAGCGAGCCGTATTCAGTTGTAGAT<br>TTTCGTTGAGTGACGGCGTGCGCAGGCGGAGTATTCGGTGCCTCGGCCGCTGCTTTCCACAGTCC<br>TCCAGTTGAGTGGCGGAAGAAGCGTTTTGCGGCTGCTTTAGCACTCAGCCGTTGTAGATGACATTAA<br>TTTGGCCAAGCGGAAAGTTCCTAGCCGTTAGCCGCGCACAGGCCAAGATAAGCTAGGCAAGCGCAT<br>TGGAGAATGTTTGCGGAAGGCGCGCTTGAAGCGCTTGCCGGCCAAGCTAAAGATCCATGCGAATTCGTGCA<br>AGCGATTGATGTGGCCCAAACCGCGGCGGCCAAGCGCTTCGCCGGCCAAGCTAAAGATATTCCGCATCAGTCA<br>GATGCCTGAAGCCAAGCAATGGAACAATGATTCGGGCTCACTGTATGTATTTTGCCGGATTAATTATGTC<br>CCGGAAGAAAAACCGCGGACCAGCTGGTTGTTTTGCTTCGGCCGCTTACCGCAGATCGCCTATTCATG<br>GAATTGAGGATGAAGCAGGATTTGAGCATCTAGGCATTGACCCTGGTCCTCTTCCAATTTTCCAATG<br>GCAATCCAAAGCGAGGATTTCTCCGGCGCCTGCTCAATAATGACATTATAGCGTGGCAAACAACATGT<br>CAGCCATGACGCCCGTATTGGAAGGCAGAAAAGGCAGTTGATTGAGCGCCTTGCCATGGCTTAAACATC<br>GCGCTGAAGGATTGTATTTGAAAGAGCCACATTTCGGGCAACTCCTCGGGCAGACCAGCAGATTCAG<br>TCAGTCGCATTGCGGGCTGGCTTTCCGATGCGCGGCAAGCTCAAGATTGCCGATGCCGTACCCAAAGCGCCGCGTCGCCGGA<br>GCGTCGCTACAGATTGTTTCTGCTCAAGCGCCTCGGATGCGGTACCCAAAGCGCGCCGTCGCCGGA<br>CTTTATTGCTTCCATCAGCGCCGTCGTTTTGAAGCGAGTTGATTGAGCGCGTTGCATGCGTTAAACATC<br>ACAGTACGCGCTTTGTACCGCTTTCATCTGAACGCCCCGCGGTCCGATCCATCGCCACAAGCGGT<br>ACAGAGGTCTGATTCCCAGGAGTGCCTTATCAAGGAACTGGATGCTGTAGATCACCTTGAATTCAACAA<br>AGCATTTCCGTTTTTTTCCGATACAGGAAGAAATCCATTCAACAACAGAAAGAGCGAATAGCAGCGAGCCCTTC<br>TGAAGAAGATAACACCGGAAACAATGGCCTTCGAATTTAACAGAAGCCATTCCAGCGCATTCCTCGATTTTTCGGGAAGGT<br>AAGGAAGAATACACGGAAACAATGGCCTTCGAATTTTAACAGAAGCCATTCCAGCGCATTCCTCGATTTTTCGGGAAGGT<br>CAAGGAGTGAGTATCGCAGCTAGAGAGTCAGCCGCGCAGGCGCCTCGTGATTTCAAATGCTTTCTGCAGAATCG<br>CGATCTTTATGCAGCTAGAGAGTCAGCCGCGCAGGCGCCTCGTGATTTCAAATGCTTTCTGCAGAATCG<br>TTTGCAGAAGCTTTACAAGCAAACCTTTCTCAATGCTCCGCAGTAATAATGCCGCGCGCTTCTGAATCC<br>GTCCTTATTTCATGGGAGAATTTTATACTTATGCGCCGAATGAAAAGAAGTTTCGTCTGCCCATGAAG<br>CGAGCGAGCCAGCTCGGATCCGGACTATGTGTTCAGCAGGCGTCAGCAGGCGTGATTGGTTGAAATCGCGCCGCGCTTTTCT<br>TGTTCGGATTGAGTGCGCGGATTGCTCTGCTGAGAGCGCGCGAGGTTTCAGTTGGTTCCTATAACTGGCTTGGAATAG<br>CAATCTCATTTTTGCTTGCAATCACTCAGCCCGAGGTTTCAGTTGGTTCCTATAACTGGCTTGGAATAG<br>CACCGTGAGCCGGTATCTTTCGGTTGCTGCGACACAATTGTACGGCACTCAACTGGAGGAGTTTTTG<br>AACGCCACAGTGCTTTCACAGATGCGTGGGCTGGCGATTTGGCTTTCATCTCAGAGTTAAAGACGGA<br>TTTGATGTCAGTTGGAGAGTTCGTCGCAGGACAATCTCCAGCATCTGCTGGTGTATCGCGCTTCGCGCG<br>ACTTGGCTGCGCTGCGAACCGGCTACATGCCCGGCTGAATTGGATCCGAAAATTCTTGTTCTGCCGGTTGG<br>TGCGTTATCGCGAGCGTAATGAAATGATTGAGCGTGCGATGAACCATTAGCAGGCGCGTATTTGCG<br>TCATCGGCCCATTCATTCCGAAGCGACTGAATCAGAGCCGTTTAAAATAAAGCCGTTTTCCGCTCAATA<br>CACAGCGCTAGCATCTTTGGCTTAATTCTTCATCCTATAGCCAGAGCCAGTATCTGGATGGATTTTTAAGCCAG<br>CCAAAGAATTGGTCATGCGCGTCTACCTCAAGCCAGCAGTGCCGTCGCCGGAACAGCCGCGTTGCTCTG<br>ATATGGAATTTGCAGGCAGCAAGTGCGCTGGTTCAGGAGATGAAGCAGTATTGGCCGCCGAATCGGTACTTGGGACTTT<br>CCAATTCAGCTTCGGCAGGCCGTCTGGTTCAGGAGATGAAGCAGTATTGGCCGCCGAATCGGTACTTGGGACTTT<br>TTCCGCCATTCCGGAGGAATAGAATTTCGTGGATGTATTAGATTCGCGAACCGCAAGAAATTCTTGA<br>GCGCGGTACGATTGCGGTAAATGCTTTTCCCAGAAGCGCCAAGAAGCCGCCAAGAGGAGGCACACAGAG<br>AAAAACAGACAGCCGGAATTTCTGATATAGGCCGAAGAAGCCGTGCAAGCTGAAGTTGACGACGCC |

TABLE 6-continued

SEQUENCE LISTING

| SEQ ID NO: | Sequence |
|---|---|
|  | AATGAATTGCACCGCAAATACACCGATGTTGCCACTCGTTTAGGGTGCAGAATTGTGGTTCAGTGGCG |
|  | CCCAGCCCAAAGCCGGGCACCAGCCGCCAACGCCCAAACAGTATACGGCCGCGAAGTGCCGACCCAAGC |
|  | GCCGCGATCTGGAAATCAAGAGCATCGTGATGAAGCCTCTTGGGGATATACTGGGGCCACCTA |
|  | TTGGGAGAAGCGCAAACCAGAGAGATATTTTGGGCATCAACCCAAGTATACTGGACCGCGGTATAGG |
|  | CGAGTCATGTCCCCGCAGTCGCCGGTTGCGCTTTGCGCTTTGGGCACATTAGGGCAACATCCACTCAAACTGAATG |
|  | GGAAAAAGAGGAAGTTGTATTCGTCGACTGAAGAAGTTCTTTCCAAGCTAG |
| SEQ ID NO: 39 | ATGGAAAGAGAATAAACAAGATACGAAAGAACTATCGCCGATAATGCCACAAGCCTGTGAGCAG |
|  | GAGCGGCCCATGAAAACACTCCTTGTCCGGTCATGACGACGCATCCTCTGAAAAAAGACTGGAGAAGC |
|  | GTCGGAAAAAGCCGAAGTTATGCCGCAGGTTATTTCAAATAACGCAGCAAACAATCTTAGAATGCTCC |
|  | TTGATGACTATACAAAGATGAAGGAGGCGCCTACAAGTTACTGCCAGGAATTTAAGGACGACCATG |
|  | TGGGCTTGATGTGCAAATTTGCCCAGCCTGCTCCAAAAAAATTGACCAGACAAACTAAAACCCGAAA |
|  | TGGATGAAAAAGGAAAATCTAACAACTGCCGGTTTTGCATGTTCTCAATGCGGTCAGCCGCTATTGTTTA |
|  | TAAGCTTGAACAGGTGAGTGAAAAAGGCAAGGCTTATACAAATTACTTCGGCCGGTGTAATGTGCCGA |
|  | GCATGAGAAATTGATTCTTCTGCTCAATAACCTGAAAAAGACAGTGACGAAGCAGTGACATACTC |
|  | CCTTGGCAAATTCGGCCAGAGGCATTGGGCAACCTATGCAAGCGGACCTGTTGGCAAGGCCCTTTCCGA |
|  | AGTAAGCCCCTGGCCACAGATTAGCCCAGTTTCTTTCGAAATATCAAGACATCATCAAGAACATCAAAAGGTT |
|  | GTGAAGGGTAATCAAAAGAGTCTAGAGAGTTCAGGGAATTGGCAGGAAAGACAGTGACTCTTGAGTACCC |
|  | ATCGGTTACACTGCCCGCCCAGCCCGCATACGAAAGAAGGGTTGACGCTTATAACGAAGTTATTGCAAG |
|  | GGTACGTATGTGGGTTAATCTTAATCTGTGCCGCATAGAAAGCTCAGCCTGATGACCGCAAAACCGCT |
|  | ACTGCGGCTAAAAGGATTCCCATCTTTCCCTGTTGTGAGCGGCGTAAACGAAGTTGACTGGTGGAA |
|  | TACGATTAATGAAGTAAAAAACTGCATTGACGCTAAACGAGATATGCGACGGTATTCTGGAGCGCGT |
|  | TACCCAGAAGAGGGCCATCAGATTACAGAAGAAATACCATCTTGAAGGATCAACTATCTGCCAAATGGCCAGTTTGAGGAAGCCATATAAA |
|  | AGAGAAGGGCAGTTTGGAAAATGCCGGAGGTCTTCGATGAGCATGGAAGGATAGAATAAGAAA |
|  | TTGAAAGAATATGCCGGAGACTGGGAAGAGGTCTTCGATGAGCCATGGAAGGATAGAATAAGAAA |
|  | ATAGCCGACTGCACAGCCATATAGAAGCCGAAGAACGCGAAGAGCGCTCAATCCAAAGC |
|  | CGTACTTACAGACTGGCTAAGGGCAAAGGCATCATTTGTTCTTGAAAGACTGAAGAAATGGATGAAAA |
|  | GGAATTCTATGCGTGTGAAATCCAACTTCAAAAATGCTATGGCGATCTTCGAGGCAACCCGTTTGCCGTT |
|  | GAAGCTGAGATAGAGTTGTTGATATAAGCGGGTTTTCTATCGGAAGCGATGGCCATTCAATCAATAC |
|  | AGAAATCTCCTTGCCTGGAATATCTGGAGAACGGCCAAGCGTGAATTCTATCTGTTAATGAATTATGGC |
|  | AAGAAGGCGCCATCAGATTTACAGATGAACAGATATATAAAAGAGCGCAAATGGCCAGGGACTATT |
|  | ATATGCGGTGGCAAGCAAAGTTATTGATCTGACTTTCGACCCGATGATGAACAGTTGATAATCCT |
|  | GCCCGTGGCCTTTGCCACAAGGCAAGGCCGCGAGTTTATCTGGAACGATTTGCTGAGTCTTGAAACAGG |
|  | CCTGATAAAGCTCGCAAACCGAAGCTATCGAAAAACAATCTATAACAAAAAATAGGCGCGGGATG |
|  | AACCGGCTCTATTCGTTGACCGGCAAACATTTGAGCGCCGGAAGTTGTTGATCCATCAAATAAAGCCTGT |
|  | AAACTTTACCGGAATTCAAGGATTCATCAGGGGGCCAACAGACATCCTGCAATAGGAGAAAGGATATAA |
|  | GGAAAAGCAGGAGGCTATTCAGGCACGCAAAGGAGGTAGAGCAAAGGCTGCGGGCTGCGGTTATTCACGGA |
|  | AGTTTGCATCCAAGTCAAAGCACCGATTCCATGTGAGAAATTCGAGACTGCTGAGAAGACCTTTTTACC |
|  | ATGCCGTTACCCACGATGCCATGACCGAAAGAACCTGGCCGCATGGGAAGGGCCAATACTGAGGCAAAA |
|  | GGACCTTTACTATAACGACTGCGATTATGACGGATGTGGTAAGCCTTAAGCATCCAACTGC |
|  | GGGTTCTTAATAACGACTGCGATTATGACGGATGTGGTAAGGCCTTAAGAAGACTCTGATGGATGG |
|  | GCAACTACCCTTCAACAACAAGAATTAAAAGCCGGAGGCCAGATACGTATTATAACCGTATAAAG |
|  | GCAAACCGTGGAAAAAGAACTCCCCGGGACGAGGCATTATTTTTGTTAAAGAAAGATTCAGCCATCGCAC |
|  | TTCTAAGTGACCAAGGGTCGCCGGACCAGGCCATGTGCGGCCATGCGAGAAGTCCGATGAACGCCATCGGCC |
|  | TGTTCAGGAACAGTTTGTTTGCCTCGATGTTGCCTCGATTGCCGATGAAGTCCACGCCGATGAACAGGCAGCCTTGAAT |

TABLE 6-continued

SEQUENCE LISTING

| SEQ ID NO: | Sequence |
|---|---|
| | ATTGCAAGGTCATGCTTTTCTAAACTCAAATTCAACAGAATTCAAAAGTTATAAATCGGTAAACAG<br>CCCTTCGTTGGTGCTTGGCCAGGCCTTTACAAAGGAGGCTTAAAGAGGTATGGAAGCCCAACGCC |
| SEQ ID NO: 40 | ATGAAAAGGATAAATAAATACGAAGGAGATTGGTAAAGATAGCAACACGAAAAAAGCCGGCAAAA<br>CCGGCCTATGAAAACCTTGCTCGTTCGGGTTATGACACCTGACCTGAGAGAAAGTTAGAGAATCTTC<br>GCAAAAAGCCGGAAAACATTCCTCAGCCATTTCAACCTTCACGTGCAAATTTAAATAAACTCCTCA<br>CTGACTATACGGAAATGAAGAAAGCATCTGATCTGCATGTTTATTGGAAGAGTTCCAAAAGACCCTGTTG<br>GATTGATGAGCAGGGTTGCACAACCAGCGCCCAAGAATATTGATCAGAGAAATTGATTCCGTGAAGG<br>ACGGAAATGAGAGACTAACAAGTTCTGGATTTGCCTGTTCCAGTGCTGTTCAACCCCTCTATGTTTATAA<br>GCTTCAACAAGTGAATGACAAGGTAAGCCCATACAAATTACTTTGGCCGTTGTAAGTCTCCGAGCA<br>TGAACGTTTGATATTGCTCTCCGCCATAAACCGGAGGCAAATGACGAGCTAGTAACGTATTCGTTGGG<br>GAAGTTCGGTCAAAGGGCATTGGACTTTTATTCAATCCACGTAACAAGAGAATCGAACCATCCTAAA<br>GCCGCTAGAACAGATCGGTGGCAATAGCTGCGCAAGTGGTCCCGTTGGTAAGGCTTTATCTGATGCCTG<br>TATGGGAGCAGTAGCCAGTTTCCTTACAAAGTGCAAATCTAACAAGAAGGGCTTGCATTTCCTAAAA<br>AAAAACGAAAAGAGATTGCAAATCTAAAGAAGAAGGGATTGAAGCTTATAACAATGTTGTTCTCAGATAG<br>TCACTCTTCCACCGCAATCTTTGGCAGAATCAAATTGGCAGGATGAGCGTTGATTGGTGGGATATGGT<br>GGCTTAAGTCCTAAACCTGAATCTTTCCGTCCTCTTTGTTGAACGCCAGCCGAATGAGGTTGATTGGTGGGATATGGT<br>CTGTAATGTCAAAAGTTGATTAACGAAAAAGAAGAGGACGGGAAAGGTCTTCTGGCAAAATCTTGCTGG<br>ATATAAAAGGCAGGAAGCCTTGCTTCCATATCTTTCGTCTGAAAGAAGAAACACGGTGAAGATTGGGCAAAGTT<br>TGCGCGTTATCAGTTTGGTGACCTTTGCTTGACCCTTTGCTTCACCTTGAAAAAGTTGAAGGTCTGAGTAAGCACATAAAGTTGGAAGA<br>AGAAGAAGGTCTGAAGATGTCCAATCAAGAAGGACGGGAAGGCAAAGGCCTCTTT<br>TGTTATTGAAGGGCTCAAAAGGCGTGATAGGAGATGAGTTTGCAGGTGTGAGTTAAGCTTCAAAGTG<br>GTATGGAGATTTGAGAGGGAAAACCATTTGCTATAGGACAGAAGAACAGCATTTTAGATATAAGCGGATT<br>TTCTAAACAGTATAATTGTGCATTTATATGCAGAAAGACGGCTAAAAGAAGTTAAATCTTTATTAATA<br>ATAATTACTTCAAAGTGTAAGATACGCTTCAAAAAAATCAAGCCAAGAGCTTTTGAAGCAAATAGG<br>TTTTATACAGTAATAATTCGCCTTTGGCCTTCATTGAAACTCGCCAATGCAGGTTATCGAACCGACCTATT<br>GAGCCTTGAGACGGGTTCATTGAACCCACTTTTGTTGCCCTGAACATTTTGAAAGAGAAGGTGCTTGACTCATC<br>GACGAGACAGGATGAACCAGACTGATAGTAATCTGATAGGAATAGACCGGGAGAAAATATCCGGACAGTCATAGCATTAA<br>GAATATAAAACCGATGAATCTGATAGGAATAGACCGGAAATATCCGGACAGTCATAGCATTAA<br>CAGACCCGAAGGATGCCCCTTGCTCAAGATTCAAAGATTCATTGGGCAATCCAACGCATATTTTTGCGAA<br>TAGGAGAAGTTATAAGGAGAAAACAACGGACTATTCAGGCTGCTAAAGAAGTTGAACAAAGGCGGGCA<br>GGCGGATATTCGAAGGGTCGATGATCATCAAGGCGAAGAATTGGCGGACGATATGGTAAGAAATACAGC<br>TCGTGACCCTCTTATATTATGCGTGTACTCAAGATGCAATGCAATCTCATTTTGAAAATCTTTCCGCGGTTTG<br>GTAGACAAGGCAAGGACTTTATGGCCGAAAGGCCAGTACACCAGGATGGAAGACTGGCTGACTGCA<br>AAGTTGCCTATGAAGGTCTGCCATCAAAAACCTATCTTTCAAAGACTCGGCACAGTATACCCTCAAAG<br>ACATGTTCTAATTGTGGTTTACAATCAATGAGAAGAGTTAAAAGTTGAAGACAGAATAACATACTA<br>ACGGCTACTGGATGATGACTACAATCAATGAGCAGAATATGCAGCGGTGCTCGAAAAGCTCAAGAG<br>TAACCGGTATAAAAGGCAGAATGTGGTAAAAGACCTCTCTGCAGTGGTGAAGCTTTATCTCTGTAAAAAGAG<br>GGTAAATAATGATATTTCTAGTTGGACAGGAAAAGTTTGTTTGCCTGAAACTGTGGTTTTGAACCCATGCAGACGA<br>ATTTAGTCACAGGCCGGTGCAGGAAGAAAATATTGCAAGTCGTGCCTCTTTCCGTTCTCAAGCAAATATAAGAAGTATCAAAC<br>ACAAGCAGCACTGAATATTGCAAGGTGGCGATTAACGGGCATTTGTTGAAACATGCAATCTTTTTACAGAAGAA<br>CAATAAAACGACCGGAAATACTGACAAAAGGGCATTTGTTGAAACATGCAATCTTTTTACAGAAGAA<br>GCTCAAAGAAGTATGGAAACCA |
| SEQ ID NO: 41 | ATGGGTAAAATGTATTACCTTGGTTTAGACATTGCACGAATTCCGTGGCTACGCGGTGACCGACCCCT<br>CATACCACCTGCTGAAGTTTAAGGGGGAACCAATGTGGGGTGCGACGTATTGCGCCGGTAATCAGA |

TABLE 6-continued

SEQUENCE LISTING

| SEQ ID NO: | Sequence |
|---|---|
| | GCGCGGAAGGACGCTCGTTCCGCACATCCGTCGTCGTTGGACGCCAAGCAGCGCGTTAAACTGG |
| | TACAGGAGATTTTGCCCCGGTGATTAGTCCGATTCCAGGCCAGCCTTCTTCATTCGTCCATGAATCCGC |
| | CCTGTGGCGCGATGACGTCGCGAAGACGCATATCCGACTATCCATCACCTGCTTGATCTGATGGAAAGCTCTGAGAAACAC |
| | GAATATTATAGCGATTACCCGACTATCCATCACCTGCTTGATCTGATGGAAAGCTCTGAGAAACAC |
| | GATCCGGCTGGTGTACCTTGCAGTGGCGTGGTTAGTGCACACCGTGCTCATTTTCTGAACGAGGTGG |
| | ACAAGGATAATATTGGAGATGTGTTCGTTCGACGCATTTTATCCGGAGTTTCTCCGCGTTCCTGTCGGA |
| | CAACCGTGTATCACCGTGGCGTGTGGAAAGCAACAGCGCTTCAGGCGACGCCTGAGCCGTAACTCAGT |
| | GAACGACAAATATAAAGCCCTTAAGTCTCTCAACTGCTGCTCGACGGCCAGAAACCTGAAGATAACCTTCGATGC |
| | CAATATTTCGAAGATGGACTCATTCAACTGAATGATAAAGAAGACGCGATAGAAGAAATCCTGGGTAC |
| | TCAGGAATCGAACGATGCATCCTTCACATTGAATGATAAAGAAGACGCGATAGAAGAAATCCTGGGTAC |
| | GCTTACACCAGATGAATGCAATGATGTGACGATTATCGCCGCCCTTTTTGCTGGGCTATCATCGAAACAT |
| | GCTCTGAAAGATGGCAGGACTATTAGCGAGTCAAAAGTCAAACTGTATGAGCAGCACCATCACGATCTG |
| | ACCCAACTTAAATACTTCGTGAAAACTCGTTGCAAAAGAATACGACGATATTTTCCGCAACGTGGAT |
| | AGCGAAACAACGAAAAAACTATGTAGCGTATTCTATCATGTGAAAGAGGTGAAAGGCACTCTGCCTAAA |
| | AATAAGGCAACGCAAGAAGAGTTTTGTAAGTATGCCTCGGCAAGGTTAAAACATTGAATGCTCTGAA |
| | GCAGACAAGGTTGACTTTGATGAGATGATTCAGCGCTCTTACCGACAACTCTTTTATGCCTAAGCAGTTT |
| | CGGGCGAAAACCGGCGTTATTCCTGACGCAGTTGTGGAAAGATGCAATTCAAGACAATTCTGAATAAAGCAGC |
| | CTCGTACCTGCCCTTTCCGCTATTCCTTACTTCCTGCGAAAAGAATAATTCGGAACATCGGAACATCGTCGATC |
| | ATGACGTTCCGTATTCCTTACTTCCTGCGAAAAGAATAATTCGGAACATCGTCGAAC |
| | GAAAGCCGGTAAGATTTATCCGTGGAACTTTAACGACAAAGTGACTTGGATAAATCAGAAGAGCGT |
| | TCATTCGCCGAATGACCAATACCTGTACCTATTATCCCGGCGAAGATGTTTACCGTTGGATTCGCTGAT |
| | CTATGAGAAATTTATGATTTAAATGAAATCAATATATTCGTATTGACGGCTACCCGATTAGTGTTGAC |
| | GTTAAACAGCAGGTTTTTGGCGTTGTTCGAAAAAACGACGCCGTAACCGTGAACGTGCCTCCATACTGATTTCATGTG |
| | CTGCTGTCTCTCGGAGCTCTGACAAACACGGGAAGCTGACAGGCATCGATACCTATCCACTCAAAC |
| | TATAATACGTATCACCCATTTTAAATCTCATGAAACCTCATGAACCGCTCCTGACCCGGATGACGTGAACGC |
| | ATCGTTGAAAGGATGACCTACAGCGACGATACTAAGCGTGCTGCGTCTGCTGCTGAATAACAATATGGT |
| | ACTTTAACCGGCCGACGATGTGAAACACATTTCGCGTTCGCTGCGCAACACAGATTTTGGCCGTTTATCCAAAA |
| | TGTTCTTAACAGGTCTGAAGGTGTCCATAAGGACCGCGAACGTGCCTCCATACTGATTTTCATGTG |
| | GAACACGAACGATAACCTGATGCAGCTCCTTCCGAATGCTACACGTTCAGTGATGAAATCACAAAGCT |
| | GCAAGAGGCGTATTATGCAAAAGCCCAGTTGTCTTAAACGATTTTTTAGACTCGATGTACATCTCTAAC |
| | GCGGTGAAACGCATTTCATCGAAATGCGTACGTGAATCAGAAAAAAAAAGAGAAGAGTGTTACACGTCGC |
| | CCTAAACGATGCAAAAACCTGTACCGCTCGATTCGTAAAGATTTCAGCAGGAAGTTGATTTTCTGAAAAG |
| | GAGCAGATCAAAAACCTGTACCGCTCGATTCGTAAAGATTTCAGCAGGAAGTTGATTTTCTGAAAAG |
| | ATCTGGAAATAATCTGATGGTCAACTTCAGTCAGATGCTTTGTATCTTTACTTTGCACAATTAGGGC |
| | GCGATATGTCACCGGCGATCCAATAAGCTGGAGCAACATCAAAGATCAGAGTTTCTATAACATAGACC |
| | ATATTACCCGCAGTCTATGGTGAAAGACGAATTCCCTAGATAACAAAGTGCTGGTGCAAAGCGAAATTA |
| | ACGGCGAGAAAAGCTTCGCGATACCCTTTGGACGCCGCAATAAAAATGAAGCCCCTTTGGGACG |
| | CTTACTATATCATGGCCTGATCTCCTTAAAGAATACCAGCGTCTAACGCGTCGACCCGTTTACCGA |
| | TGATGAAAAATGGCGTAAGTTTCCAGGACGGGGTTATTGTTCCGACTTCAGA |
| | CATGAATTCGGCCTTGTAAAAGTCAATGAAAGATTCAATCGCAGAATGGTTTATGGTGAACCAGCCGTATCTTGGCTA |
| | TAAAACTAAAACTCTTTTACCCACAGCATAAACAGCATTAAGAATGCAACTTCGTTCGTGCCTGGAACGGCGAAGAAGA |
| | TCTCGGTCGTATTGTAAAATGCTGTAAAATGCCAGCACATTCACTCACTTCACGCGCTTCTCCTTCGAT |
| | CGCAAAGAAGATTATTGATATCAACCTCTGAAAGCCAGCGACTATACCACCGGCTATACGCGGT |
| | CTGAATGTCGTAAATACGGCGATATGCGATATCCAAATCTACCGCCTATTACCTGCTGGTGAGGTTCACGC |
| | TGGAGGACAAGAATTCTTACCGATTATGCGCCAAGCTGATGATTCCGTAGAAGGCTGTACAAGGCTCGCATTG |
| | ATCATGACAAGAATTTCTTACCGATTATGCGCCAAGCTGATGATTCCGTAGAAGGCTGTACAAGGCTCGCATTG |
| | AGAAAGTGATCAATATTATGTTCCAATGGGTACGAGGCATATAAAACTCAATGATTAGTATCG |

TABLE 6-continued

SEQUENCE LISTING

| SEQ ID NO: | Sequence |
|---|---|
| | ATGGCTTCTATCTTAGTATCGCGGAAAGTCCTCTAAAGGTAAGTCAGTTCAGTTCTATGTCACGCAATGGTTC<br>ACTGATCGTCCCTCACAAATCGAATGTTACATTAAAGCAATGAAAGTTCGCCCGAAGTTTAAAGA<br>AACAACAAGCTGCCATCGTAGAAAATTCGATAAAATAAGTCCGTTGAAGACAACCTGAATCTCTACGA<br>GCTCTTTCTCCAAAACTGCAGCATAATCCTATAATAAGTTTTTTCGACACAGTTTGACGTACTGACG<br>AACGGCCGTTCTACTTTCACAAAACTGTCGCCGAGGAACAGGTACAGACGCTCTTGACCATTTTAAGT<br>ATCTTTAAAACATGCCGCAGTTCGGTTGCGACCTGAAATCCATCAAGCCAGTGCCCAGGCAGCGCGC<br>ATCATGATTAGCACGTCGACTTAACTGACTGTCGAAAAATATTCAGATATTAGGTTGGTTGAACAGTCA<br>GCTTCTGGTTTGTTCGTATCCAAAAGTCAGAACTTACTGGAGTATCTCTAA |
| SEQ ID NO: 42 | ATGTCATCGCTCACGAAATTCACTAACAAATACTCTAAACAGCTCACCATTAAGAATGAACTCATCCCA<br>GTTGCAAAACCTGGAGAACATCAAGAAGATGTCTGATAGATGGCGACGAGCAGCTGAATGAGAA<br>TTATCAGAAGGCGAAAATTATTGTGCGAACTGTTTCTGCGGGGACTTCATTAATAAGCACTGAATAATACG<br>CAGATCGGAACTGCGCGAACTGGCGATGCGGATGCCCTTAATAAAGGAGGATGAAGATAACATCGAGAAATT<br>GCAGGATAAAATTCGGGGAATCATTGTATCCAAATTTGAAACGTTTGATCGTTTAGCAGCTATTCTATT<br>AAGAAGATGAAAAGATTATGACGACAATGATGTTGAAGAAGATGGTCGGCAAGAA<br>GACCAGTCATTAAATACATATTTAAAAAAAACCTGTTTAAGTTAGTGTTGCCATCCTACCTGAAACC<br>ACAAACCAGGACAAGCTGAAGATTATTAGCTCGTTTGATAATTTTTCAACGTACTTCCGCGGGTTCTTG<br>AAAACCGGAAAACATTTTTACCAAGAAACCGATCTCCACAAGTATTGCCTATCGCATTGTTCATGATA<br>ACTTCCCGAAATTCCTTGATAACATTCGTTGTTTTTAATGTGTGGCAGACGGAAATGCCCGCAACTAATCGT<br>GAAAGCAGATAACTATCTGAAACTATCTCTCTGCAGATGGTATAGATTTTTACAACAATATATAGGTGGACTG<br>CGTGGGGCGCTATGACTATTTCCTGTCTCAGAAATCCAAGGTCTCAATGAATTCATCAATCAAGAGTGCCAAAAGAC<br>CCAGCGTTCGCCGGCCATGAGAAAATCAAGGTCAACCCGCTTCACCGCGTTCAAAATGGCGTACTGCTTCAAACAGATACTC<br>AGCGAGCTGAAAGTAAGCTGAAAAACCGTCACCGCTTCAAAATGCGTCAAGCTACTGTTCAAACAGATACTC<br>AGCGATCGTGAAAAAAGTTTGTAATTGATGAGTCGAGTCGATGCTCAAGTTATTGATTAAATCGATTATAAATCTTAAA<br>AACTTTTACGCCGAACAGTGCAAAGATAACAATGTTATTTTAACTATTCATTGAAGGAAATACCTGTCGAGCGGTTAGTCAA<br>CTTTCTTAAGTGATGACGAACTGGACGCATATTACGTGACGCATATTCATTGAAGGAAATACCTGTCGAGCGTTAGTCAA<br>AACTTATAGCGCGATTGGTCAAATTCCATCACAGGAACATTGAACGACATTGAAGATATTTTCTACTTAAAGACGC<br>AAGCAGCTGGCCAAGAGATCAAAACCAAAAGGAGTGTAGAAAAAGCCATCTCAAACTCCTCGAAATATGAGTTC<br>TCGCTGTCGGAACTGCGATTCGAACTGTACATGACAAGTGAAGGTGTTGTACCCCTTAGTTGTACACTGC<br>ATAAGGTGGCTTCTGAGAACCTAAGAGCCGCCTTGAAGGTTGAAGATCTGAAGTCCCCCAAACATCCAAGAATAAT<br>GAAGAGCAAACAAAAATCAAGAGCCGCTTGATGCTCTGCTGCTGGAGATCTATAAATACACTTCTGATTTTT<br>AACTGCAAAAGCTTCAATAAAAAACGCAACTTCTATGTCGACTATGATCGTTGCATCAATGAACTGAGT<br>TCGGTCGTGTATCTGTATATAAAACACGTAACTATTGCACTAAAAAACCCTATACACGGACAAGTTC<br>AAACTCAATTTTTAACAGTCCGCAGCTCGGTGAAGGCTTTCCAGGTGCAAAGAAATGACTGTCGACT<br>CTTTTGTTTAAAAAAGACCGACAACACCGACAATTGCCATTTATCCCAAAGGTCGCAAAATCAATTTGATG<br>ATACAAGAATCGCGAACAACCACCGCAATTACATCTTTAAATGAATATTTCCTACCTAAAGACGC<br>AAAAATTATCCCGAAATGTAGCATTCAGCTCGAAAGTCCAAGGCCCATTTTAAGAATCTGAAGA<br>TGATTACATTTTGTCTGATAAGGAGAAAATTGCTAGCCCGCTGTCATTAAAAGAGACACATTTTTGCTG<br>CCAACTGCACATGTGAAATTACCCGAAAATGGAGTTCTGTTTGTAAGAGTTCTTAAAAACTTATAAA<br>GCGGCTACCCATTTTGTATAATCAACCACCATTGAAAAGACCAGAGGAATATGCTGATTATTGTAGAATTCTAC<br>AAGGATGTCGATAATCTGTGCTACAAACTGGAGTTCTGCCATCAATAACAAAGACTTCAGCAGTAAATCGACCGGCACC<br>ATAGATAACCGGCGACCTGTATCTGTTCGCATCTATATTCGATGAACGTAATCCGACAATTATGC<br>AAGAACCTTCATACGTTATATTACCAAGCTGTTCTATCGTAAAGAAAGTATTGAGCAGCAGAAAACCTATCACACAAA<br>TGAATGGGGAGCAGAACTTCGTGAATAAGGTGTAAAGACGTACAAGCCTGATGATAAGTATAGAAAGGTGTTACCGATGTCA<br>GCCGTTCAATTCTCGTGAATAAGGTGTAAAGACGTACAAGCCTGATGATAAGTATAGATACGTAATGAA<br>ATTTATCAATAATGAGAGAAAATTTATTGATACCCTGTCTGATGAAGCTAAAAAGGTGTTACCGATGTCA<br>TTAAAGGAAGCTACCCATGAATTATAAGGAGGCGATAACCAAGCAGTTCAATAACGAAGTGCTCAGTTCCTG<br>CCCCCTGACAATTAATTATAAGGAGGCGATAACCAAGCAGTTCAATAACGAAGTGCTGAGTTTTCTGCG |

TABLE 6-continued

SEQUENCE LISTING

| SEQ ID NO: | Sequence |
|---|---|
| | TGGAAATCCTGACATCAACATTATCGGCATTGACCGCGGAGAGCGTAATTTAATCTATGTAACGTTATA
AACCAGAAAGGCGAGATTCTGGATTCGGTTTCATTCAATACCGTTCAACAAGAGTTCAAAATCGAG
CAGACAGTCGATTATGAAGAGAAATTGGCAGTCCCGAGAAGAGAGGATTGAAGCAAAACGTTCCTG
GGACTTCTATCTCAAAAATTGCAACTAAAGGAAGTTATCTGAGCGCAATAGTTCACGAGATCTGTCT
GTTTAATGATTAAACACAACGCATCGTTGTTCAAAATTCAAAATGTTTAAGCTGAACTATTTTGTCA
GGTTTATCAGAAAAAAGTGTTTATCAAAAATCGTCTGGTCTGCTGAATGACTCAGCTTTCGATCAGTTTG
GCAAGAAGGAATCCGACTGACTTGAATAACGTCTGGTCTGCTGAATGACTCAGCTTTCGATCAGTTTG
AAAGCTTCGAAAACTGGGTATTCAGTCTGGTTTTATTTTTACCGTGCCCGGCTACGCAATGTTGATCGATCAAAGAT
TGATCCGACCACGGCTTCGCCAATGTTCTGAATCTGTCGAAGGTAGCCAATGTTGATCGATCAAAAG
CTTTTTTTCTAACTTCAACGAAATTAGTTATAGCAAGAAAGAAGCCCTTTTCAAATTCTCATTCGATCTGG
ATTCACTGAGTAAGAAGCTTTAGTAGTTGTAAATTAGTAGAAATGAAGCTTACACCTT
TGGAGAACGTATCATAAAGCCAAAGAATAAGCAAGTTATCGGAGGACAAAGAATCAACTTGACCT
TCGAGATGAAGAAGTTACTTAACGAGTATAAGGTTCTTTTGATCTTGAAAATAACTTGATTCCGAATCT
CACGAGTGCCAACCTGAAGGATACTTTTGAAAGACTATTCTTTATCTTCAAGACTACGCTGCAGCTC
CGTAACGCGTTACTAACGGAAAGATGTGCTCATCTCCGTCAAAAATGCGAAGGGTGAATTC
TTCGTTTCGGAACCCATAACAAGACTCTTCCGACAAGATTGCGATGCGAACGGTCATACCATATTGCGT
TGAAAGGTCTGATGATACTCGAACGTAACAACCTTGTACGTACGGAGGAGAAATACGAAAAAGATTATG
GCGATTTCAAACGTGGATTGGTTCGAGTACGTGCAGAAACGTAGAGGCGTTCTGTAA |
| SEQ ID NO: 43 | ATGAACAACTACGACGAATTCACCAACTGTACCCGATCCAGAAACCATCCGTTTGAACTGAAACCG
CAGGGTCGTACCATGGGAACATCTGAAACCTTCAACTTCTCAACTTCTTCGAAGAAGACCGTGACCGTGCCGAAAAA
TACAAATCCTGAAACTCTGGAACACATTCATCCTTCAACAAAAATCATCGACGAACCTGACCAACAT
GTCTCTGGACTGGAACTCTCTGAACAGAATCTCTGTCAAAAAATACTACCAAATCTCTGAAGAAAAGACCAG
AAAGTTTCTCTGTCTGAACAGAAACGTATGCGTCAGGAAATCGTTCTGAATTCAAGAAGAAAGACGAACCG
TTTCAAAGACCGTGTTCTCTAAAGAAGCGCTGAAGCTCTTTCGACAAATTTCTCTGTTACTTCATCGGTCTGCACGAAAC
CCACCAGGAAATCGACGCGCAGAAATCGACGATCTCAACCGATCCTCAACCTATCGTTAACGAAAACTTC
CGTAAAAACATGTACTCTGACGGTGACGAAATACCAGGAACGGCGTAAAAAATACCCGAATGATCATCAA
AGCGGAAATCGCCGTCCGTGGTTCCGCACAACATCAAAATGGACGAAGTTTTCTCTCTGGAATACTTTCAACAA
AGTTCTGAACCAGGAAGGTATCCAGCGTTCAACAACCTGGCACCAGTCTGAAAATCTTTCTAAAGGCTAT
AAAAAATGATGGCTGAACGACGCCCTGTTCAAACAGATCTGTCAAAAAGAATCTTCTCTTACATCCCGGACGTTTTC
ACCGAAGACTCTCAGCTGCTGCCGTCATCGGTGTGTTTCTCGCCAGATACAGCACCGAACTATCTACATCC
AACATCTTCGACCGTGCGTGGACTGGAACTGTCTTCTTCTAACCGTATCTCCGGTGAATGCGACCACCGAACCGAACTATCTACATCC
GTCAGGCGGACATCAACCGTCTATCACGACATCAACCTGAAACTGGAACGTACCTGGGTGTCTGATGCG
TGAATACAAAGCGGACTCTATCAACGACATCAACCTGAAACTTGACAACAAGTTGACAATGCTG
GGACTTCTAAAGAATTCCGCGTCTTGCGTCTGACGTTCTGGAAGCCGATCAAACGTAACACGACCGTT
CAACGAATACATCTCTAAAATGCTACCGCGCGTGAAAAATCGACGCCGCGCGTAAAGAAAATGAAAT
TCATCCTGAAAATCTCTGGTGACGAAGAAATCATCCACATCATCAAAACCCTGCTGACTCTGTTCA
GCAGTTCCTGCACTTCTTCAACCTGTTCAAAGCGGTTCAGGAACATCCCCGTGGTCCGGTTCTACGCG
GAATTCGACGAAGTTCACTCTAAAACTGTTCGCGTCCGTGTACACAAAGTTCGTAACTACCTGA
CCAAAAACAACCTGAACACCGAAGTTGAACTTCAAAAAACCGACCCTGGCGAACCGTTGG
GACCAGAACAAAGTTTACGACTACCACCGTCTGCGCTGATCTCCGTGACCGGTAACTACTACCTGGGTATCA
TCACCGGAATCGTAAAAATACATGTCGAAAACACATCGATCGATCGACTTCTGGTAACGGTTCCGTTCCGTTCTACCCTAAAA
GAATTGGACGAAGTTCACTCTAAAACTGTTCGCGTCCGTCGTCGGTAACAAACCTGAACTACCTGA
CAAATCGACCCTGAACACCGGTCTAAAGAATCATCAAAAAACCCGACCTTCTTCACCGAAGGT
TGGTTACACAGATCCCGGTCCGAACAACATCATCGAAGGTTACGACTTCTTGACCTTCTACCGTAAA
AAAAGAATACAAACCGTCTAAAGAATACCAAAAAATCGAAGCGGACAAACTGAAGGTTATCTACCGTAAA
AATTCGACCTGGAACATTTCCGCACAACTGATCGACTTCTCTCAAAGAAATCTATGAAAAACAAAGAC
TGGTCTAAATTCAACTTCTACTTCCTCCGACCGAATCTACGGTGACATTCTGAATTCTACCTGACGT
TGAAAAACAGGGTTACGCTTACCACTTCGAAGAAAACATCTCTGCGGAAACATCTCTGCGGAAATCGACGAAGC
TGAAAAACAGGGTTACGCTTACCACTTCGAAGAAAACATCTCTGCGGAAATCGACGAAGC
TGAAACAGGGTTACGCTTACCACTTCGAAGAAAACATCTCTGCGGAAATCGACGAATACGTTGAAAA |

TABLE 6-continued

SEQUENCE LISTING

| SEQ ID NO: | Sequence |
|---|---|
| | AGGTGACCTGTTCTGTTCAGATCTACACAAAGACTTCGTTAAAGCGCGACCGGTAAAAAGACAT |
| | GCACACCCATCACTGGAAGCGCGGCGTTCTCCCGAAAACCTGCAGGACGTTGTGTTAAACTGAACGG |
| | TGAAGCGGAACTAGTTCTACCGTGACAAATCTGAACATGAAGAAATCGTTCACCGTGAAGTGAAATCCT |
| | GGTTAACCGTACCTACACACGGTCGTACCCCCGGTTCCGGACAAATCCAAAACTGACCGACTACCA |
| | CAACGGTCGTACCAAAGACCTGGGTGAAGCGAAAGAATACCTGGACAAAGTTCGTTACTTCAAAGCGCA |
| | CTACGACATCACCAAAGACCGTCGTTAACCTGAAGAACGTAACCTGTCTGTACTACTTATCGACCCTGAAC |
| | TTCAAAGCGAACGGTAAAAAAACCTGAACGTAAACGCGTTTCGACTACTGTGTACTACTATCGACCGTTCTGGTAAA |
| | GCACATCATCGGTATCGACCGTGTGAACCTTATCGACCGTTTCGACTACCGTGAAAAACTGAACCAGCGTGAA |
| | ATCATCGACCAGCAGTCTTCTGAACGTTATCGACGCGCTCAGTCTTGAACGCGCTAAAATCAAAGACCTGAAAGAAGGTTA |
| | CCTGTCTAAAGACGGTTCACGAAATGCAGTCAGTACAACGTCGATCGTTTATGAAGA |
| | ACTGAACTACGGTTCAAACGTGGTCGTTTCAAAGTTGAAAACAGATCTACCAGAAAATCGAAAACAT |
| | GCTAATGCGACAAAATGAACTACCTGGTTTCAAAGACGCGCCGGAATCTCCGGGTGGTGTTCTGAA |
| | CGTTCCGGCGGCGTACACCCTCTAAAATGCACCGACCACCGGTTCGTTAACCTGTTCAACACCTCTCT |
| | AAAACCACCGCGCAGGAACTGTAAAGAATTCCTGCAGAAATTCGGTACCTCTAAAATCGAATTCGCGAAAGAC |
| | GGTGTATCTTCGCGTTCGCGTTGAACTGAACGCTATGGCGTTACATCAAAGAAAAAAACGTAACGAACTGTTCGAC |
| | CCGTCTAAAGAAATCAAAGACGGTGACCTCTCTGGTATCAAATCAAAATACGACGGTGTCAGAACATCCTG |
| | CCGGACATCCTGCCGTTCTAAACAACAGGTCTGATCTGACTACATCATCTCTCCGATCACGACGGAACCTAACGAACATGCGC |
| | AGATGCGTGTTACGACGGTAAAGAAGACTACATCATCTCTCCGATCACGACGGAACCCTAACGAACATGCGC |
| | TCCGTACCGACCCGAAACGTCGTGAACTGCCGATCGACCGGACCCGGAACCGGTGCGTACAACATCCTG |
| | TGCCGTCGAACTGACCATGCGTCGCGATCGCGTCGTCGAAAAATTCGACCCTGTGAAAAATGGCGAAAAC |
| | TGGAACTGAAACACAAAGACTGGTTCGAATTCATGCAGACCCGTGTGACTAA |
| SEQ ID NO: 44 | ATGACTAAAACATTTGATTCAGAGTTTTTAATTGTACTCGCTGCAAAAACGGTACGCTTTGAGTTAA |
| | AACCCGTGGGAAGAACCGGCTCAGTTCATTTGTGAAGACTTTAAAAACGAGGCTTGAAACGTGTTGAGCG |
| | AAGATGAAAGGCGAGCCGTCGATTCCAGAAGTTAAGGAAATAATTGACGATTACCATCGGGATTTCA |
| | TTGAAGAAAGTTAAATTATTTTCCGGAACAGGTGAGTAAAGATGCTCTTGAGCAGGCGTTTCATCTTTA |
| | TCAGAAACTGAAGGCAGCAAAAGTTGAGGAAATGCTTCTGGACTGAATAAAGCCGCTTCTCAAGGATTGAT |
| | AAAAAGGAACTGATTAAGGAAGACCTGATAAATTGGTTGTGTCGCCAGAATCGCGAGGATGATAATCCCT |
| | ACGGTCGAAACGTTTAACAACTTCACCAAGCTATTAGCTTTCGCCTTATTCATGAAATCTTCCAAAGTTTTTTGACAA |
| | CCAAAGATGATCACGCCACCGTATTAGTTGAAGAGGGTTTTCCCTGAATAGAAATATTTGATAAAGTGAAAGAGGATTT |
| | CGTGATTAGCTTCAATAGTCTGAAGCATCGTGTTGAATGAATTCGTTAACTTCGTGACCAAGCGGG |
| | AGAAGTAGATTATGATCTGAAATAGAAATATTTCGTTAACTTCGTGACCAAGCGGG |
| | CATAGATCAGTATAATAATCGTTCAAACAACACGCAAACGCGTCAGATTCCTAAACAATTGAAAGTGA |
| | ATGAGCAAATTAATCGTTCAAACACAGGATTCTCACTGCAGAAGTTACATATATCGCCAGATAAATTCACCGTGCTGCAACA |
| | CCCGTTCAAACAGATTTGTTCGATTCACTGCAGAAGTTACATATATCGCCAGATAAATTCACCGTGCTGCAACA |
| | TCAGAGTTGTTGCGATTCACTGCAGAAGTTACATATATCGCCAGATAAATTCACCGTGCTGCAACA |
| | AGCCATTCTCGGTTCGGCAGAGGCCGGATCGTCTTTAAGAAGGTTTTCGGAATCTGATTTAAATGCCTTTA |
| | TCTAACACCATTTTCGGAATTACAGCCGGTCTCTTTCCGATGCATCAGACTACCTGATTATTAAAGAAAGCTGAAAA |
| | CGAAAAAGGCGAGGCTTTTGAAGAACTACCGGACACCTCATTATTCGACACCCTCATTCAATACTGG |
| | AACAGTTCAATTCCAGCCTGAACGTCGGAAAATCCAGCGACACCGACACCGCTCTCAGGTGCAGCCTTTGTT |
| | AGACCGATGAATTATATTCTCGCTTCATTAAATCACTAGCAGCCGAATCGAAGATGAACCTACTTCATCA |
| | CGAACTGGAAGCCCTGTCATCAAAGCGCCCCCACCCGGAATCGAATACGCTGATACGCTATTGAAGATGAAAGGCAGG |
| | AAGGCTTGAGCGATCAAGCGTATTAAGGTTCACTAAAGGATGCGTAAATGATACCGTTATGAAGCGGTCACTTTGCAA |
| | AGCCTTGTATCTTGTTAAGGGTACCAAGAACCTGAATCGTTAATCATTCCTATCTATACAAAGCGGAGCTATCT |

TABLE 6-continued

SEQUENCE LISTING

| SEQ ID NO: | Sequence |
|---|---|
| | GTCGGGGAAACCTTTCAAGGCCGATAAATTCAAGATTAATTTGACAACAACACGCTACTGAGCGGATG<br>GGATCGCAACAAGGAAACTGCTAACGCGTCCATTCGTCTTGTTTAAGAAAGACGGGTTATATATCTTGGAAT<br>TATGCCGAAAGGTAAGACCTTTCTTCTTTGACTACTTTGTATCGACGATTCAGAGAAACTGAAACA<br>GCGTCGCCCAGAAGACCGCCGAAGAAGCTCTGGCGCAGGATGGTGAAAGTTACTTCGAAAAATTCGTTA<br>TAAACTGTTACCAGGGGCTTCAAAGATGTTACCGAACATGTCTTTTTAGCAACAAAAATATTGGCTTTAC<br>AACCCGTCGATGACATTTACGCATTGCAACACAGCCTCTCACCAAAAACGGGACCCCTCAGAAA<br>GGCCACTCAAAAGTTGAGTTAACCTGAACATGTCTCATAAGATGATTGATTTCTCAAATCATCAATTC<br>AGAAACACCCCGAATGGGGGTCTTTTGGCTTTTACGGTTACGTAATTACCGTTTCTCGATCACGTGATTTGAAGACATGAGTGC<br>CTTCTACCCGGAAGTAGAAAACCAGGGTTACGTATTATTCCAGATTTATAACAAGGATTTCTCGCCTACAGCAA<br>AGGCAAACCAAACCTGCATATCTGCTTATGTAATCGTGTTTGAAGAAGCGAACCTGATAACGTAGT<br>GGCGAAGTTGAACGGTGAAGCGCAATTGAAGCGAAATCTTCTTCCGTCGTCACTCCATTAAGGCCTCTGATAAGTGTC<br>CATCCGCAAATCAGGCCCATTGATAATAAGAATCCACACGAAAAACGCAGTCAACCTTTGAATAT<br>GACCTCGTTAAAGACAAACCGGTTTCAAAGTTTAATGATAAAGTCAATGGGTTCCTCAGAAGTCAACA<br>AAGCACAAGGGGTTCAAAGTTTAATGATAAAGTCAATGGGTTCCTCAGAAGTCAACCCGATGTCAACA<br>TTATAGGTATAGAACAGGGCGAACCCATCTGCTTTACTTTACCCTAGTGAATCAGAAGGTGAAATAC<br>TGGTTCAGGAATCATTAAATACCTTGATGTCGACAAAGGCACGTTAATGATTACCAGCAGAACTGG<br>ATAAAAAGAGAACAGGAACGTGATGCTGCCGTAAATCGTGAGAACATTAAGAGCTG<br>AAAGAGGGGTATCTAAGCACCATTGTACACAAACTGGCGCACATCATTCATCATTAAATATAACGCAATAGTC<br>TGCCTAGAAGACTTGAATTTGGCTTTAAACGTGAATTATCTGGTTTTAAAGAAAAGGAACTTGTGAGTAGGG<br>CACTACTTGACAGTTATCACTGACGCCCCGTTCGAATCATTCAAAAACTGGGCAACAGTCTGGC<br>ATTCTGTTTTACGTGCCCGACAGATATACTTCAAAAATCGATCCAACAACTGGCTTGTGAACTTCCTGG<br>ACCTGAGATATCAGTCTGTAGAAAAAGCTAAACAACTTCTAGCGATTTTAATGCAATCGTTTTAACAG<br>CGTTCAGAATTACTTTGAATTCGAAATTGACATTATAAAAACTTACTCCGAAACGTAAGTCGGAACCCA<br>AAGTAAATGGGTAATTTGTACGTATGGCATGTCAGGTATCAGATCCGTCGAATCAAAGGTCATG<br>GGAGACCGAAGAAGTGAACGTGAAAAAGCTGAAGGCTCTGTTCGCGACGATTCAAAAACTACA<br>CTGTGATCGATTACCGACAAATGATGATAACCTGAAACTTACGATGACCTTACGGGATAAAGCCAGCTTTT<br>TAAAGAACTGTGTGGCTCCTGAAGAATGAGCAGGGTGAATTCTATGATAGTAGGAAAGCCGCGAAGTGTG<br>TTTTATTCTGTCACCGACGCCGACGCCAATGGCGCTATCATATCGCCGTCAAAGGGCTTTGGAATTTGCAGCAGAT<br>TAACAGTGGGAAAAGGTAAAACCCTGAATCTGGCTATCAAAAACCAGATTGTTTAGCTTTATCCA<br>AGAGAACCGTATCAGGAATGA |
| SEQ ID NO: 45 | ATGCATACAGGCGTCTTCTTAGTATGGACGCCGAAAGAGTTCACAGGTCAGTATCCGTTGTCGAAACA<br>TTACGATTCGAACTTCGGCCCTACGTGCGCCAACCAGCCCACGTGGATAACCTGGAGTACTTCCTGA<br>GACCGCCATCGTGCGCAAATGTTATCCTCGTGCCGAAAGAGTTATTGGATGACAACATCGTGCCTTCCTGA<br>ATCGTGTGTGCCACAACGATATCGATTGGATTGGCACCCCGATTGCGAGCGCTTTTGTAAGGTACATAAAA<br>ACCCTGGTAATAAGAACTTGCCCAGGATTACAACCTTCAGTTGTCAAGCGCCCGTAAGGAGATCAGCG<br>CATATCCTTCAGGATGCAGATCGTATAAAGGCCTGTTCGCGAAGCCTGTTAGGACGAAGCTATGAAAA<br>TTGCCAAAGAGAAATCATGAGTCACGCGAGAACGAAAGTGATATTGAGGTTCCGAAGCGTTTAACGGTTTAGCGTATCT<br>TCACCGGTTATCATGAGTCACGCGAGAACGAAAGTGATATTAGCGATGAGGATATGGTGAGCGTAGCCTACCGAA<br>GGATATTATCCTGAAGTATCGGCAACTCTTGAAGCATTGATGACATTGGTAAGTACTTTGACGTGTCGAAC<br>TATAACAATTTCTTCTCCAGGCGTTTAATGTCGTATTGAATGACTACAATCACATTATTGGCGCCATACAACCAAG<br>ACGACTGATAACAGCTTAATGTCGTATTGAATGACTACAATCACATTATTGGCGCCATACAACCGAAG<br>TTCAGTTCAAACAGCTCTACAAACAAATCCGAGCGTGCGTACCAGCAAAAGCTACATCCGAAACAGT<br>TTGACAACTTCAAGGAGATGGTTGACTGCATTTGCGATTATGTCAGCAAATAGTCAGCAGATGAGAATCCGAAACAG<br>TAGAACGGCCCTGAAACTAGTGTCCGTAATATCAGTTCTTTCGACTTGCCGGGGATCTTTGTCAATAAAA |

TABLE 6-continued

SEQUENCE LISTING

| SEQ ID NO: | Sequence |
|---|---|
| | GAACTTGCGCATACTGAGCAACAAACTGATAGGAGATTGGACCGACGATCGAAACCGCATTGATGCATAG<br>TTCTTCATCAGAAACGATAAGAAAGCGTATATGATAGCGCGGAGGCTTTTACGTTGATGACATCTTT<br>TCAAGCGTGAAAATTGTCGATCCTCTGCCGAAGATATTGGCAACAGGCGGAAGACATCTGTAGA<br>GTGATAAGTGAGACGGCCCGTCTCAAAAATTCGGGAGCTCGAGCGTGAGCCTGATAGCTTCATGAACGACGAT<br>GGTTATGAAGCGGGCCGTCTCAAAAATTCGGGAGTCGCTGAGCCTGAGCCTTATATGGATCTTTTCCATGAACTGG<br>AAATTTCTCGGTTGGCGATGAGTTCCCAAATGCCAGCATTTTACAGCGAACTGGAGGAAGTCAGCG<br>AACAGCTGATCGAAATTATTCGTTATTCAACAAGCGCGCTATATCGTTCTCCGAAACGCTATAGCAC<br>CGATAAGATTAAAGTGAACTTAAAATTCCCGACCTTGGCCGACGGGTGGGACCTGAACAAAGAGAGAG<br>ACAACAAAGCCGGATTCTGCGGAAGACGGTAAGTATATCTGCGAAATCTGATATGAAGAAGATC<br>TGTCAAGCATTAGGACCAGCGACGAAGATGAATCCAGCTTCGAAAAGATGGAGTATAAACTGTTACCGA<br>GTCCAGTAAAAATGCTGCCAAAGATATTCGTAAAATCGAAAGCCGCTAAGGAAAAATATGGCCTGACA<br>GATCGTATGCTTGAATGCTACGATAAAGGTATGCATAAGTCGGTAGTGCGTTTGATCTTGGCTTTTGCC<br>ATGAACTCATTGATTATTACAAGCGTTATTACGGGAGTTGTATCCCAGGCTGGATGTGTTCGATTTCAAGT<br>TCGGCGAAACTTCCGATTATGGGTCATGAAAGAGTTCAATGAAGATGTGCCGAGCCGGTTACTATAT<br>GAGTCTGAGAGAAAATTCCGTGCAGCGAAGTGTACCGTCTGTTAGACGAACTGATTTATCTATTTCA<br>AATTTATAACAAAGATTACTCTGAAAAATGCACATCGTAATAAGAACATGCATACCATGTACTGGGAGGG<br>TCTCTTTCCCGCAAAACTGAGTCGCCCGTTTCAAGTGTCGGGTGGGCAGAACTTTTCTTTCGA<br>AAATCCTCAATCCTAACGATGCCAAAACAGTACACCCGAAAGGCTCAGTGCTGGTTCCACGTAATGAT<br>GTTAACGGTCGCGGTATTCCAGATTCAATCTAACCGGAACTGACACGCTATTTTAACCGTGGCGATTGCC<br>GAATCAGTGACGAAGCCAAAAGTTATCTTGACAAGGTTAAGACTAAAAAAGCGGACCATGACATTGTG<br>AAAGATCGCCGCTTTACCGTGGATAAAATGATGTTCCACGTCCCGATTGCCGATGCCAGAACTTTAAGGCGATC<br>AGTAGATAAATAGATCCGACCACTGGTTTCGCCGATCTGTTCATTTATGATGAGAAGCTAAACGTAGC<br>ATTGATCGTGGGAGCGGAACTTAATTTACGTCACGATGGTTGACAGAAAAGGAATATCTATATCAG<br>GATTCTTAACATCCTCAATGGCTACGACTATCGATCTCTGAAAGCTCTGATGTGCGAATATGACACAAG<br>GAAGCGCGTCGTAACTGGACTAAAGTGGAGGGCATTCGCAAATCGCAAAATGAAGGAAGCTATCTGTCATTAGCG<br>TTCAAAGCGGGCCGCTCAAAGATTGAATAGATTGAAAATAACGCATCATCGTTATGGAGAGTATGCTGATTAACAAA<br>CTGGCTATATGGTTAAAAGACAAGTTCAATCAGAACAAGTTATCGACCAATCACTGCATGGATACCAGCTG<br>GCGAACCATGTTACCACCTTAGCATCAGTTGGAAAGCAGTGTGGGTTATCTTTTATATACCGCCAGCGT<br>TCACTAGTAAAATAGATCCGACCACTGGTTTCGCCGATCTGTTCTTTGCTGAGTAACGTTAAAACGTAGC<br>GAGCGCTGAATTCTTTTCCAAAATGAAATCTGTCATTTATGATAGAAGCTGAAGGCAAATTCGCATTC<br>ACTTTGATTACTTGGATTACAACCGAAGAGCGAATGTGTCGTACGCTGTGACCGTTTACACCGTTG<br>GTGAGCGCTTCACCTATTCCCGTGTGAACCGCGAATATGTACGTAAAGTCCCACCGATTATTCTATGA<br>TGCCCTCCAGAAAGCAGGCATTAGCCTCGAAGGAGACTTAAGGAGACAGAATTGCCGAAAGCGATGGCG<br>ATACCGTGAAGTCTATTTTTTACGCATTCAAATACGCGCTAGATATGCCGTTGAAGAATCGCGAGGAAG<br>ACTACATTCAATCACCTGTGAAAAATCTGTGAAAATTTTTTTGTTCAAAAAATGCTGGTAAAAGCCT<br>CCCACAAGATAGCGATGCAAACGGTGCATATAACAATTGCCCTGAAAGGTATTCTTCAATTACGCATGCT<br>GTCTGAGCAGTAGACCCCAAACGCGCAAACGGGAATCTCATTAGACTTCCGCTGATAACCATAAAGCCTGGCTGAC<br>ATTCATGCAGTCTGGCAGTCGCATGAAGAACCTGGAAAAATTAG |
| SEQ ID NO: 46 | ATGGATAGTTAAAAGATTTTTACGAATCTATATCCGTAAGCAAAACTCTTCGTTTGAACTGAAACCTG<br>TTGAAAACGTTGAGAATATCGAAGACGGCATCCTGAAAGAAGACGAGCACGTGCCGAAAGC<br>TACAGGCGTGTCAAAAAGATTATCGATATCATGTTCATTGAGGTCTGGAGAACATG<br>GCAAAAATGGCATAGAAGGTGAAGATAAAAGCACTGGAACAAATTCGCGCGTTTGCGAGCTCACAAGAAAGA<br>TCACCGAACGGAAGTGAAGATAAAGCACTGGAACAAATTCGCGCGTTCTTCGGGTCTGATTGTTGG<br>CGCGTTCACCGGCCTGTGCCGCCGTGAAGCGCGCAGAACGAAAAGTACGAGTCGCTCTTCAA<br>AGAAAAACTGATAAAAAGAAATTTGCCTGACTTTGTGCTTTCGACCGAAGCGGAATCCCTGCCATTTCT<br>GTCGAAGAAGCGACCCGACCCGAAAGAAGATTTGACTCCATTCACAAGTTACTTTGCAGGCTTCTACGAA<br>AACCCTAAAAAACATCTACAGCACCAGGAGCCACAGAGCACCGCTATTGCTTATCGCCTGATTCATGAGAAC |

TABLE 6-continued

SEQUENCE LISTING

| SEQ ID NO: | Sequence |
|---|---|
| | CTGCCGAAGTTCATCGATAACATCCTTGTTTTTCAAAAAATTAAAGAGCCGATTGCGAAAGAGTTAGAA |
| | CATATTCGAGCTGACTTTTCTGCGGGTGGGTCATTAAAAAAGATGACGGCTGGCGAAGACATCTTCAGT |
| | CTAAACTATTATATCCACGTTCTGTCGCAGCAGGCATTGAATGAACATATCAATCTGTATAACCAGCAGTGGTC |
| | TCACGAAGGCGATGGTGAGATGAAAGGTCTTAATGAACATATACAGATCCGTGTCTGACCGGGACAGCTGTCCTA |
| | GCGAAGACCGTCTCTCCACTGTTCCGCCCACTGTATAAACAGATCCGTGTCTGACCGGGACAGCTGTCCTA |
| | CCTGCCGAAAGCTTTGAAAGGATGAAGAGCTACTTCGCGATGAGACGATCTGAGTAGAATCTA |
| | GGAAGACATTTGGGTAGAACGCAGCATCGATGACGTCAATTTCTGAAGATCGATCTGAGTAGAATCTA |
| | CGTTAGGAATGATAGCCAGCTGACCGATATTAGCAAGACACCGAACGTATAACCGCAGAATATGAGCGTGATC |
| | GGCACGTGAACGTGCATATGATCATGAAGAAGAAGCATCTCACTCGACACCTGACCTCTGTATCGCTTTCTTAG |
| | GCATTAAGGCGCTAAAGGCGAATTGTCGCGTCGCATCTGTCACACCCTTGGGCACGAAGAGGGTCCACATGTC |
| | ATAACGTGCCGATTGTCGCGTCGCATCTGTCACACCCTTGGGCACGAAGAGGGTCCACATGTC |
| | TGTCTAACCTGGTGGAAAATGTCTTTGCGAGTTACCATGAAGCGGAACAACTGCTGTCTTTTCCATACCC |
| | CGAAGAAACAATCTAATACAGGATAAAGATAAGCTGGTGTTAATCAAAAACTGCTGACAACATCA |
| | GCGATCTGCAACGTTTCCTGAAACTTTGTGGGTATGGGTCAGAGCCAGACAAAGACGAACGTTTT |
| | ATGGTGAGTATAATTATATATGTCTGACCAAGTTATTCCGCTGTATAACAAAGTACGGAACTA |
| | TCTGACCCGTAAGCCATATTCTACCGTAAAGTGAAACTTTGGCAACTCCAACTGCTGTCGGGT |
| | TGGGATCGTAACAACAGACAAGACAAGCAGGACAAGATCTGTAATATTGGTGTTCATCTGCTATCAAAGGGAACCG |
| | ATTATGAACAACAGATCTATAAGCGTTTCATTTGAAAAATCACTGAAGAAGTTACCGAAAGTCTTCTTGA |
| | TACTTCGAGAAATGGATTATAAGTCTTCTTACCAGACCCTTAATAAGATGTTACCGAAAGTCTTCTTTCGA |
| | AAAAAGGCATAGAAAATCTATAAGCCGTCTCCCGAAATTACTCGAACAGTATGGGCACGGACCCACAAG |
| | AAAGGGGATACTTTTTTAGCATGGACGATCTGCACGAATCTGATTTTTTTAAACACTCCATCGAAGCCC |
| | ATGAGAGACTGGAAACAGTTGGGGTTCAAGTTCTCGATACAGCCACATACAGAGAATTGTCAGTTTTTTA |
| | TCGGAAGTGGAGGATCAGGGTCAGTTAGTTTTGCGAAAGTTTTCAGAGAGTTATGTTTATAGTTTA |
| | ATTGATCAGGGAAACTTTACCTGTTCCAGATCTACAACAAGATTTCTCGCCATGTAGTAGGGTACCC |
| | CGAATCTGCTACACTCTATTGGAGAATGTTATTCGATGAGCGTAACTTAGCGGATGCATTATAAAT |
| | GAACGGGAAAGCAGAGATCTTTTTCGTGAAAAATCACTGAAGAATGACACCGACTCATCCGCCGG |
| | GAAACCGATCATTACATATGGATAAATTCAATTCATGTTCAATTACAATGACATGACATGACTCGGTGA |
| | AAGACCGTCATTAGTAAATGATATGGTAAACGCCCATATTGCGAAGCGAAAGATATGCATGTTATTGGCAT |
| | GGGTTTCCAAAGTAAGAGCCGAAAGAACTGCTTTATATTTGCGTAATTGACAGCCGTGGTACCATTCTGACCAGAT |
| | CGATAGAGGCGAAAGAACTGCTTTATATTTGCGTAATTGACAGCCGTGGTACCATTCTGACCAGAT |
| | CTCTTTAACCACCCATCAATGACATCGATTATCACGACCTGTTGGAGTCTCGGGACCAAGGACCCGCAGCA |
| | GGAGGCCGTAATTGCAGACAATTGAAGCATAAAGATAAAAGATTAAAACAGGGTTACCTTTCCAGGCCGT |
| | ACACCGCATAGCGGAACTGATGGTGCCTACAAAGCCGTAGTTGCCTCGGAAGACTTGAATATGGGGTT |
| | TAAACTGCCCGTCAAAAGTCGAGCAGCGTGTATCAGCAATTGAAAGTCGCTTACCAGTTTTAC |
| | GAATTATTTGGTTTGATAAAAGAACAGGTAAAGATATTTGGTGCATTACGCTGCATACCAGTTTAC |
| | GGCACCTTTAAGTCCTTCAAGAAATGGTAACAAGACCGGGTTTCGTTTACATCCCGGCCTGGAAT |
| | ACATCCAACATCGATCCTACCACCGGGTTTGTCAACCTGTTTCATGCACATAAAAGATGTGATCAAAACGTGATAAA |
| | GCGAAGAGTTTTTTCGATATATTTCGATAGTATTCCGGGATCCGCAGTATGTGGATCCTCTGACCCATGGCA |
| | GTCGATTATAAAAATTTTCGTAATTCCAAAAGAATGCCAGTGGGACTCGGAAGAGTTGCCCTGACCG |
| | AAGCGTTCAAATCGCTGTTTGTACGCTACGGAAATTTTGTAGATCTCCTAAACTGTTCAAACTGACTGTTCAGATGCGCAATTC |
| | ATGAAAAACAGAAGAAAGACCTGGATTATCTGATTAGCCCGGTAGCCCAATGGTGCAATGTGTCATAACATATTGCATTAAGGG |
| | TCGTGAAGGTAACAAGTCTCCCAAAGATGTCATGCCAATGTGTCATAACATATTGCATTAAGGG |
| | GCTATGGGCCTTGCGACAGATCCGCAGACCAGCCAAGCTGAAAGGGCAAGCTGAAATTGGCCATATCGAATAA |
| | GGAATGGTTACAATTTGTTCAGGAACGTAGCTATGTCAAAAAGATTGA |
| SEQ ID NO: 47 | ATGAACAACGCACAAATAATTTCAGACTTCATCGGATCCAAGTTTGCAGAAACGCTGCGCAAT |
| | GCTCTGATCCCACGGAAACCACGCAACAGTTCATCGTCAAGAACGAATAATTAAAGAAGATGAGTTA |

TABLE 6-continued

SEQUENCE LISTING

| SEQ ID NO: | Sequence |
|---|---|
| | CGTGCGAGAACCGCCAGATTCTGAAAGATATCATGATGACTACTACCGCGATTCATCTCTGAGACT
CTGAGTTCTTATTGATGACATAGATTCAGCCTAGCCTGTTCGAAAAATGGAAATTCAGCTGAAAATGGT
GATAATAAAGATACCTTAATTAAGAACAGAGTATCGGAAAGCAATCCATAAAAATTTGCGAA
CGACGATCGGTTTAAGAACATGTTTAGCGCCAAACTGATTAGTGACATATTACCTGAATTGTCATCCAC
AACAATAATTATTCGGCATCAGAGAAAGAGGAAAAAACCAGGTGATAAAATGTTTTCGCGCTTGCG
ACTAGCTTTAAAGATTACTTCAACGATTCTTTTCAAATGCTTTTCAGCGACGATATTTCATCAAGCAGCT
GCCATCGCATCGTCAACGACAATCGAGAGATATTCTTTCAAATGCGTCTGGTCTACCGCCGATCGTAAA
ATCGCTGAGCAATGACGATATCAACAAAATTTCGGGCGAATATTGAAAGATTCATTAAAAGAAATGAGTCT
GGAAGAAATATATTCTTACGAGAAGTATGGGGAATTTATTACCCAGGAGGCATTAGCTTCTATAATGA
TATCTGTGGAAAGTGAATTCTTTTATGAACCTGTATTGTCAGAAAATAAGAAACAAAAATTATA
CAAACTTCAGAAACTTCAACAACTTCTATGCATTGCGGACACTGAGGTCCCGTATAAATT
GAAAGTGACCAGGAAGTGTACCAATCAGTTAACGCTTCCTTGATAACATTAGCAGCAAACATATAGTC
GAAAGATTACGCAAAATCGGCGATAACTATAACGGCTACAACCTGGATAAAATTTATATCGTGTCCAAA
TTTTACGAGAGCGTTAGCCAAAAACCTACCGGACTGGGAAACAATTAATAACCGCCCTCGAAATTCAT
TACAATAATATCTTGCCGGGTAACGTAAAGTAAAGCCAAAGTAAAAAAGCGGTTAAGAATGA
TTTACAGAAATCATCACCGAAATAAATGACTAGTGTCAAACTATAAGCTGTGCAGTGACGACAACAT
CAAGCGGAGACTTATATACCGAGTTGAATCCGAGCTCAAAGCGAGTGACTTAAAACGTGTGGACGTGAT
CAATGAATGCGTTTCATTGGTGTCGGTTTTATGACTGAGGAACTTGTTGATAAAGACAACAATTTTAT
GCGGAACTGGAGGAGATTTACGATGAAATTTATCAGTATGAAATTGAACTTTGGAATAACCGACGTTCGTAACTAC
GTTACCCAGAAACCGTACAGCCACAAAGAGTATTCTAATACCGCTATCATAGCGCGACAATCTGTATTATCTGGGCA
TGGTCAAAGTCCAAAGACTTGATATCACTTTCTGTCATGATCGATCGACTACTTCAAAAACTGTATTGCAA
TCTTTAATGCGAAGAATAAACCGGACAAGAATTATCGGAGGTTATGCGACACCAGTACTTATGGAAGACATTTCCGGGTT
TTATCGTGAGGTAGAGTTACAAGGTTACAAGATTGTACAAGATTGCATCATTAGCGAAAAGACATTGATCT
GCTGCAGGAAAAGGTCAACTGTATCTGTTCCAGATATATAACAAAGATTTTTCGAAAAAATCAACCGG
GAATGACAACCTTCACACCATGTACCTACCTACCGGAAATCTTTTTCTCAGAAGAAAATCTTAAGGATATCGTCCTG
AAACTTAACGCGAAGCGAAACTTCTTCAGGAAGCAGCATAAAGAACCCAATCATTCATAAAAA
AGGCTCGATTTTAGTCAACCGTACCTACCGAAGAAATAAGACCAGTTGGCAACATTCAAATTGT
GCGTAAAAATATTCCGGAAGCAGCCAAACTGAAGAATGTAGTGGGACACCACGGCAGCGACGAATATAGTCA
GCTGTTCTGATGAAGCAGCCAAACTGAAGAATGTAGTGGGACACCACGGCAGCGACGAATATAGTCA
AGGACTATCGCTACACGTATGATAACTTCCTTCATATGCCTATTACGATCAATTTCAAAGCCAATAA
AACGGGTTTATTATGATAGGATCTTACGATCGCTAAAGAAAAGACTTACATGTGATCGGCATT
GATCGGGCGAGCGTAACCTGATCTACGTCCGTGATTGATACTTGTGTAATAGTTGAACAGAAA
AGCTTAACATTGTAAACCGGCTACGACTATCAGATCAGATAAAACTGAAACAACACGAGGGCGCTACCGAGCTTAGTAAT
GCGCCAGAAGCAATGGGAAGAAATTGGTAATACAAATATAGCGATGATGAGGATTTGTCTTATGGTTTT
CCACGAGATCCTAAAATGTGAATCAAATACAAATGCAATATAGCGAAGGATTTGTCTTATGGTTTT
AAAAAAGGGCGCTTTAAGGTCAAACGGCAAGTGAAACCATGCTGTCATCAATAAACTC
AACTATCTGTATTTAAAGATATTTCGATTGGGTCAATATCTTTAAATTAAAGACCTGACAGTGACAT
ACATTCCTGATAAACTTAAAAACGTGGGTCTGACAATATCTTTAATTTAAAGACCTGACAGTGACAT
GAGCAAAATTGATCCGACCACCGGCTTCTGTGAAATATCGTATGCAGCAGTGAAAAAATCTTTTTACATTT
ACGTGAATTCATTAAAACTTTATTACCGACCAAGTATGAACGGCGCTCATTAACAGGTACAGGACGCGAAA
GATTACAATAAACTTTATTACCGACCAAGTATGAACGGCGCTCATTAACAGGTATTGACGACGCATAACCAAA
GATATGGAGAAACGTTGCAGCAGACACGTTGACCAATGGCCACATTCTGCTCAAGACATT
ATAGATTATGAAATTGTTCAGCAGACACATATTGAAATTTCCGTTTAACAGTGCAATGCGTAACTCCTTGT |

TABLE 6-continued

SEQUENCE LISTING

| SEQ ID NO: | Sequence |
|---|---|
| | CTGAACTGAGGAGACCGTGATTACGATCGTCTCATTTCACCTGTACTACTGAACGAAAATAACATTTTTATGA
CAGCCGAAAGCGGGGATGCACTTCCTAAGGATGCAATGGTGCGTATTGTATTGTATTGCATTAAA
AGGGTTATATGAAATTAAACAAAATTACCGAAAATTGAAAGAAGATGGTAAATTTCGCCGATAAACT
CAAAATCAGCAATAAAGATTGGTTCGACTTTATCCAGATAAGCGCTATCTCTAA |
| SEQ ID NO: 48 | ATGACCAATAAATTCACTAACCAGTATTCTCTCTAAGACCCTGCGCTTTGAACTGATTCCGCAGGGGA
AAACTTGGAGTTCATTCAGAAAAAGGCCTTCTTCAGGATAAACAGAGGCTGAATCTTACCAAG
AAATGAAGAAAAACATTGATAAGTTTCATAAATATTTCATTGATTTAGCCTTGTCTAACGCCAAATTAAC
TCACTTGGAACGTATCTGGAGTTATACACAAATCTGCCGAAACTAAGAAACAGAACAGAAATTTAAAGA
CGATTTGAAAAAAGTACAGGACAATCTGCGTAAAGAAATTGTCAAATCCTTCAGTGACGGCGATGCTAA
AAGCATTTTTGCCATTCTGCAAAAAAGTTGATTACTGTGGAGTTAGAAAAGTGGTTGAAAAACAA
TGAGCAGAAGAACATCTACTTCGATGAGAAACCGAACTCACCGCCATTGCGTATCGTTGATCCATGAGAAT
AACCGGAAGAACATGTACTCAGTAGAACTGGAAAAGCCTTTGAAAAGATTAAGCAGGTCGAATCGCTGCAAGTGAAT
CTGCCTAAATTTCTGGAGAATGCGAAAGCCTTTGAAAAGATTAAGCAGGTCGAATCGCTGCAAGTGAAT
TTTCGTGAACTCATGGGCGAATTTGGTGACGAAGGTCTAATCTTCGTTAACGAACTGAAGAAAATGTTTC
AGATTAATTACTACAATGACGTGTCATCGCAGAACGGTATCACAATCTACAATCAATAACTACAACCAAACAAGGACA
CACAAAAAACGATATAAAATACAAAGGCTGAACGAGTATATCAAACAGATTTATCTGACAGAATCTCCCTGAGCT
TTCTGCCGGATGCTTTCACTGATGGGAAGCAGGTTCTGAAAGCAGTTTTCGATTTTATAAGAATTAACTT
ACTGAGCTACACGATTGAAGTCAAGAAGAATCTCAAAACTTCACTGCTCTTGATCCGTCAAACCATTGA
AAATCTATCATCGTTCGATACGCAGAGAAATCTACCTCAAAAACCATATCCACCTGATGCTGAAACCAAAGTCAATCCGA
CAGGTTTTCGGGGATTTAGTGATTTCGAACTACTGGGTATGAAAACCCTTGAGTAGAAGCTAAAAGCCGTAT
AATTCGAGACGAATATTCTAAGGCCCGAAAAAAACGCTTCTGATAGTTCTTGATAAGCCGAT
TTACTAAACAGGATTACTTTCGTTAAAAAAACCAGCAGCAATTGCATCGGTCAATTTCATCAAAACCACTTTGTCG
CATAACATCTGATATCTGAAAAACAGAACAGAACAAGACTTTCGATTTCATTGCTAACATCACCGCAAAATACCAGTGTA
TTCAGGGTATCTGGAAAACGCCAATACGAGAAGCTCGACACTCAACCGCTTCATTAAGAGCG
AATTAAAATTCTTCTTAGATGCAATCCTGGAGCTGCTGCACTTCATCAACCGCTTCATTTAAGAGCG
AGTCCATTACCGAAAAGGACACCGCCTTCAATACGTAACCCAGAAGCGCAATAAAGAAGGTGACTACCTCACCACCAT
GACTCCGCTGTATAATAATCGATACGCACAGCTCTCAACGGTTGGGACGCAATAAAGAAGGTGACTACCTCACCACCAT
GAACTTGAAAACGCACAGCTGCTCAACGGTTGGGACGCCAATAAAGAAGGTGACTACCTCACCACCAT
CCTGAAAAAAGATGTAACTATTTTCTGCAATTATGGAATAAGAACATAATAAGCATTCCAGAAATT
TCCTGAAGGGAAAGAAATTACGAAAAGATGGTGTACAAACTCTTACCTGGAGTTAACAAATGTGCC
GAAAGTATTTTTAGTAATAAGAACATCGCCTACTTTAACCCCGTCCAAAGAACTGCCTGAAAATATAA
AAAGGAGACCCATAAGAAAGGGGATTGAATATTCGATTTCAGTTTAGTGAGACCAGGCACTCTTAAGAGCAAAACCTG
GAATTCCCTGAATAACAACACAAGATTGGAAATATTCGATTTCAGTTTAGTGAGACCAGTCATACCA
GATCTTAGCCGGCTTTAACTATTTCGCGAAACTAGAAACAAGCGTATAAAATTAACTTCAAAAACATCGACAG
CGAATACATCGACGCGTTTAGTTAACGAGGGCAAATGCATACGTGTACTGAAAGCCACTCTTGAAGAGCAAAACCTG
CCGTTCTCTAAAGCCAAACCGATATGCCATACGTGTACTGAAAGCCACTCTTGAAGAGCAAAACCTG
CAGAAGTGATTTATAAACGAACGCTGAGATTTTTCGTAAAGCTGAATTAACCGAAA
AATATCATCCTTCATAAGAAGAAAATAAAGATCGTAAAACATTGAATATGGCAAGATATCGGAAGG
CTCCGAAATAGTGCCTGTCAAAACAATTAAGAACTGCTATATCGATTAACTTTTCGATTTTTACGAAAAACAAGACGATC
GACATCATCAAAGATAAACCTCACTGTAGTAAGTTCCGATTACTATGAACTTCA
AAGCTACCGGGGGTAGCTATATCAACCAAACGGTGTGGAATACCTGCAGAATACCCGAAGTCAAA
ATCATTGGCTGACCGCGAATACCATTACGATCAAGATGCGTAAATCGGATCGAGTCATATCGGCAACATC
TTAAAACAAGAATGCTGCAACCTGCCCGTAAAACTGGGACCACCGTGCGAAACATTAAGGAGTTAAA
GGAGGGTTATATTCCAGGTAGTAGTGCATAAGATCGCCACTCTACGTCTCATGCTCGAGGAAATGCGATCGTTGTC |

TABLE 6-continued

SEQUENCE LISTING

| SEQ ID NO: | Sequence |
|---|---|
| | ATGGAAGACTTAAACTTCGATTTAAACGTGGGCGATTTAAAGTAGAGAACAATCTACCAGAAGTTA<br>GAAAAAATGCTGATTGACAAATTAAATTACTTGGTCCTAAAAGACAAACAGCCCGCAAGAATTGGGTGGA<br>TTATACAACGCCCTCCAACTTACCAATAAATTGAAAGTTTTCAGAAAGTTTCAGCAAACAGTCAGCTTTC<br>TTTTTATGTTCCTGCGTGGAACACATCCAAATCGACCCTACAACCGGCTTCGTCATTACTTCTATACT<br>AAATAGAAAACGTCGACAAAGCAAAAGCATTCTTTGAAAAGTTCGAAGCAATACGTTTTAACCGTGAG<br>AAAAAATATTTCGAGTTCGAAGTCGACACTTACGGCGAGCGCATCGAAGACGAAGCGTCAAAAAGATCAGAATAACAAATT<br>GCGTGGACAATCTGCACCTATCACCTGACCGGAAGACTTTTGAAGAATTCAGAGACTTCTTAGGTAAAAATCAGATTGTTTATGGC<br>GACGGTAACTGTATAAAATCTCAAATAGCCTCAAAGGATGATAAAGCATTTTCGAAACATTATTATATT<br>GGTTCAAAAATGACACTGCAGATGCGCAATAGTGAGACGCGCAATATTGATTTATCTTTATCAGCCCGG<br>TCATGAACGACAACTGCTACTTTTTACAACTCCAGAGACTATGAAAAACTGAATCCAACTCTCCCCA<br>AAGATGCTGATGCGAACGGTGCTTATCACATCGCCAAAAAAGGTCTGATGCTGCTGAACAAATCGACC<br>AAGCCGATCTGACTAAGAAGTTGACCTAAGCATTTCAAATCGGGACTGGTTCAGTTTGTTCAAAAGA<br>ACAAATGA |
| SEQ ID NO: 49 | ATGGAACAGGAATATTATCTGGACTTGGACATGGGCCACCCGGTTCCGTCCGCTGGGCTGTTACTGACAGT<br>GAATATCACGTTCTAAGAAAGCATGGTAAGGCATTGTGGGGTGTAAGACTTTCGAATCTGCTTCCACTG<br>CTGAAGACGCGTAGAAGTTTAGAACGAGTCTAGACAGCGCCAATTGGAGAATCGAATTT<br>TACAAGAAATTTTGCGAAGAAGAATATCTAAGAAGACCAGCGCTTTTCCTGAGAAGAAGAATCTA<br>AGTATTACCCTGAGAATAAGGATTACCATAAAAGAGTTTCCAACTATCTACCATTTACGCAAAATGTTAATG<br>CGATCGATTTTACCGATAAGGATTACCCAGACATAAGACTAGTTTATCTGCAACATATCACCCATATGATGAAACATAGAGGC<br>AATACAGAGAGAAACCCCAGACATAAGCCAGAATCAACGAAATCAAAGAGGTTGATTGACACCATTTAGTAAGTTACTGCGAAA<br>CATTCTTACCTTCCCGGGGATATCAACGAAATGTTGAAGGAAGAATTTATGATTTCATTAAAAGAATGTCTTA<br>ACATAAAGAATGAAGAATAATATGCTGAATAGGTCGACCAAAAAACTAGGCTGATCAAAGCACTGAAAGCCAA<br>ATCCTGAAGGATAATATGCTGAAAAAGCTGTTTTAAATTACTTGCTGGTGGCACTGTTAAGTTATCAGACATTTTGGTT<br>TGGAAGAATTGAACGAAACCAGCGTGGGCGACAATTAGTTTCGCTGACAATGCTACGATGATTACATTG<br>GTGAGGTGGAAACAGTTGGGCGACAATTTATATTATAGAGACGCTAAGGCAGTCTACGATGACTGGG<br>CTGTTTAGTAGAAATCCTTGGTAAATACCATCTATCTCCGAAGCGAAAGTTGCTACTTACGAAAAGCA<br>CAAGTCCGATCTCCAGTTTTGAACAAACTGAAAATATCTGACTAAGGAGAATAAGATATAAGATAT<br>TTTCGTTAGTATCCTGCAAAGCAAAGGTGTTCGAAGGAGAATTTTATGATTCATTAAAAAGAATGTCTTA<br>AAAGTTGATCTGCAAAGCAAAGGTGTTCGAAGGAGAATTTTATGATTCATTAAAAAGAATGTCTTA<br>AAAAAATTAGAAGGTCAGCCAGAATAATTTGAAAGAAGAACTGAAAGAGAGACATTCTTACC<br>AAACAAGTCAACAGAGAATAATGGGTAATTCCATATCAAATTCACCTACGAATTAAAAAAATTTT<br>AGGCAATTTACGCGATAAATTTGACCTTATCAAGACAAATGAGGATAAGCTGGTTCAACTCTTTGAATT<br>CAGAATACCCTATTATGTGGGCCAAGATTGATGACGCAAAGAAGGTAAATTCACATGGGC<br>CGTCCGCAAATCCAATGAAAAAATTTACCCATGGAACTTTGAAAATGTAGTAGATATTGAAGCGTCTGC<br>GGAGAAATTTATTCGAAGAATGACAAGTACATGTCTAAACGACTTACGTTCAACACGTTAAGTTCGCCTAAGA<br>CAGCTTATTGAATTGAAACAAAGATTGTATACTGACGTCTTCTGCAAGTACAAGATGCAGTTAAAAA<br>AGTGTAGATGCGAATTGAAACAAAGATTGTATACTGACGTCTTCTGCAAGTACAAGATGCAGTTAAAAA<br>AATTAAGAATTACTTGAAGTGCGAAGTATAATTCTGAAGACAGTTAGAGATTACTGGTATTGATGGTGA<br>TTTCAAAGCATCCCAGATTACTCTAACAGCTTACCACGATTTATAATATTGTCTTTTCGGTGATGACAGAACTGACGGAACTGACGTTGAAGAAAAGACT<br>GAATAAGGAAAACAATTATTATTCCCCAATCAACTTAAGAAAATTGTGCTTTTGCTTCTTACACGGATGG<br>GGTCGTCTTTTCAAAAAGTTCTTAGAAGAGATTACCGCACCACCTGAACTTATCCAGACGAAGACTTCTGAGCAATGCAATGAATCGTTTCATGG<br>ATAATTACCGCCTTTATGGAATCGAACAAATTGGCAAACCAGACAATAATCCATATTGCACCACCTGACAACTTTATCCTATGAAAACTGTCAACGGATTCAAAGAATATGT<br>AAGAAGTTGAAGTTTCAAGATGCTACAACATGGCAAACAGACAAACAGAGACTTTATCCTATGAAAACTGTCAACGAATTAGAAAGGTAA<br>ATGTATCAGCTCTTGCTTAAAACGTGTGTTTATTGAAGGAGTCTAGAAATGCTAGAAAAAAACAAGAGTCAAAAGAACCGAG<br>TGAAGGAGTCCTCCTAAACGTGTGTTTATTGAAGGAGTCTAGAAATGCTAGAAAAAAACAAGAGTCAAAAGAACCGAG |

TABLE 6-continued

SEQUENCE LISTING

| SEQ ID NO: | Sequence |
|---|---|
| | TCAAGAAAGAAGCAGTTAATCGATTTATATAAGCTTGTAAAACGAAGAGAAAGATTGGTTAAAGA<br>ATTGGGGGACCAAGAGGAACAAAAACTACGGTCGATAAGTTGTATTTATACTATACGCAAAGGGAC<br>GATGTATGTATTCCCGCGAGTCAAATAGAATTGAAGGATTTATGGACAATACAAATATGACATAGACC<br>ATATATATCCCAATCAAAAACGATGGACGATAGCTTGAACAATAGAGTACTCGTGAAAGAAAATATA<br>ATGCCACCAAATCTGATAAGTATCCTCTGAATGAAAATATCAGACGAGCGTCTAATAAGAAACACCGAGTTATCGC<br>CCTTGTTAGATGTGGGTTTATAAGCAAAGAAAGTACCAGGCGTCTAATAAGAAACACCGAGTTATCGC<br>CAGAGAGAACTCGCTGTTTTATTGAGAGGACAAATGTGAAAACGAAGAACAATCTCAAGACCGTTGCTG<br>AGATCCTAAAGCAAGTTTTCCCAGATCGGAGATTGTCTATGTCAAAGCTGGCACAGTGAGCAGTTTA<br>GGAAAGACTTCGAACTATTACCTAAAGTAAGGAGAAGTGAACGATTTACATCACGCAAAGGACGCTTACCTAA<br>ATATCGTTGTAGGTAACTCATATATTGTTAAATTTACCAAGAACGCCTTCTTGGTTTATAAGGAGAACCC<br>AGGTAGAACATATAACCTGAAAAGATGTTCACCCTGGTTGGAATATTGAGAGAACCGAGAAGTCGC<br>ATGGGAAGTTGGTAAGAAAGGGACTATAGTGACAGTAAAGCAAAATTATGACAATAATATATATCCTG<br>TTACAAGGCAGGTTCATGAAGCAAAAGGCGGCCTTTTGACCAACAAATATGAAGAAGGAAAGT<br>CAAATTGCAATAAAAGAACCGATGAGAGACTAGCGTCAATAGAAAAGTATGGTGCTATAATAAGC<br>TGCGGGTGCACACTTTATGCTGTGAATCAAAAGACAAGAAGGTAAGACTATTAGAACTATAGAATT<br>TATACCCCTGTACCTTAAAGAACCAAAGATCCTGTTAAAAAAGATTGAATCGGATGAGTCAATCGCGTTAAATTTCTAGAGAAGG<br>AAGGGGTTTAAAGAACCCAAAGATCCTGTTAAAAAAGATTGAATCGGATGAGTCAATCGCGTTAAATTTCTAGAGAAGG<br>ATTTAAAATGTGGGTTATCTGCAGAACAGGCGATAGACTTTTGTTTAAGTGCCGTAATCAATTAATTTG<br>GATGAGAAAATCATTGTCACAATGAAAAAAATAGTTAAGTTTATTCAGAGAAGACAAGAAAAACAGGGA<br>GTTGAAATTATCTGATAAGATGGTATCGACAGTCAGGTTAAGTGAACAAGCCAAAACATTAATTGATAAACAAAA<br>AAACTTGAAAATACCGTATATCGAATCAGGTCAGGTTAAGTGAACAAGCCAAAACATTAATTGATAAACAAAA<br>GAATTTCAGCAGCTAATTTAAAATGATTGGCGACCTGGGAAAGCCATCCTAGTGATGAACAATA<br>ATATCCAAGTGTAACAAAATATCAATTATTAACCAATCTCCGACAGGTATTTTGAAAATGAAATAGA<br>CTTGCTTAAGAATATAA |
| SEQ ID NO: 50 | ATGTCTTTCGACTCTTCCACCAACCTGCTACTCTCTGTCTAAAACCCTGCTGAAATTCGAAATTGCGTCCGGTTGG<br>TAACACCCAGAAAATGCTGACAACGCGGGTGTTTTCGAAAAGACAAACTGATCCAGAAAAATACG<br>GTAAAACCAAACCGTACTTCGACCGTCTGCACCGTGGTTGACTGGCAGAAAGACAAACAACGTTGCAA<br>TGATCGGTTCTGGACGAAAACTTCCCTGACCGTCTGCGTACCGAACATCGGTAAAATCTTCAACCTGAAAGCGG<br>AAGACTGGGTTAAAACACAAAACCCGATCTGGGTCTGAAAACAAAACACCGACATCCTGTTCGAAG<br>AAGCGGTTTTCGGTATCCGAAAGCGCGTTACGGTGAAGAAAAAGACACCTTCATCGAAGTTGAAGAAA<br>TCGACAAACCGGTTAAATCTAAAATCAACCAGATCTCTATCTTCGACTTCTGGAAAGGTTTCACCGGTTA<br>CTTCAAAAAATTCATCGACAACCTGTTCATCGACCACCAACCTGTCTATCTGTTAATCGTTGTGCAGAA<br>GTTGACCTGGCGGAAAACTGGAAAATCTTTCTGACTACTACACAAATCATCGGTGGTGAAACCCTGAAAACGG<br>CAAATGCCTGCTGCAGGACGGTATCGACGAACTGATCAACAGTACCGTCAGAAGAACAACCAAGAAAATCC<br>CGTTCTTCAAACTGTGATCGGTCTGACAGAAACATCCTGACTGCAAATCGTTCCTGACGAAATCAAAAACG<br>ACACCGAACTGATCGAAGCGCTGTCTGAAAACAATGGACCTTCGCGAAATCTAAATACGACCTGGCGCAGATCTACATCTCTGTTCGAAGCG<br>AAACTGTTCGCGACCATCTCTAACAAATGGACCTTCGCGAAATCTAAATACGACCTGGCGCAGATCTACATCTCTGTTCGAAGCG<br>GCGTTCAACACCATCTCTAACAAATGGACCTTCGCGAAATCTAAATACGACCTGGCGCAGATCTACATCTCTGTTCGAAGCG<br>ATGAAATCTGGTAAACTGGCGAAATAGCAAGAAAAAGACAACTCTTACAAATTCCCGGACTTCATCGCG<br>CTGTCTCAGATGAAATCTGCGCTGTCTGTCTATCTCGCTGTCTGAAAGGTCACTTCTGGATCTTCCTGTACGAATTCAACT<br>AAATCTCTAAATTCCAGGAAAAACCAACCAGGGAACAGTTCCTGCGAATCTTCCTGTACGAATTCAACT<br>CTCTGTTCTCTGACAAAATCAACACGTCGTTCGAACAGATCGTCGAACACCAAAGACGGGTGAAACCCCGAAAGACTCTAAAGTTACCATCAAG<br>AAGACCTGCACCAACCTGATCGTCTGAACAGATGCGAAATCTGTTCCGAAGACTCTAAAGTTACCATCAAAG<br>ACTTCGCGGACTCTCTTCTGACCATCTACCAGATGCGAATAACTTCGCGGTTGAAAAAACGTGCGT |

TABLE 6-continued

SEQUENCE LISTING

| SEQ ID NO: | Sequence |
|---|---|
| | GGCTGGCGGAATACGAACTCTTTCTACACCCAGCCGGACACCGGTTACCTGCAGTTCTACGACA<br>ACGCGTACGAAGACATCGTTCAGGTTTACACAAACTGCGTAACTACCTGACCAAAAACCGTACTCTG<br>AAGAAAATGAAACTGAAACTCTACCCTGGCGAACGGTTGGGACTACAAAACAAAGAATCT<br>GACAACTTCGCGGTTATCCTGCAGAAAGTGGTAAATACTACCTGGGTCTGATCACCAAAGGTCAAC<br>AAAATCTTCGACGACCGTTCCAGGAAAAATTCATCGTTGTATCGAAGGTGGTAAATACGAAAAATC<br>GTTTACAAATTCTTCCGACCAGCCGAAAATGTTCTCCGAAAGTTTGCTTCTGCGAAAGGTCTGAAT<br>TCTTCCGTCCGTCGAAGAAATCTCGGTATCTACAACAACGCGGAATTCAAAAAAGGTGAAACCTACT<br>CTATCGACTCTATGCAGAGAAATCGATCGACTTCGTAACCTGCCTGACCAATACGAAGGTTGGGCGT<br>GCTACACCTTCCGTCACCTGAAACCGACCGAAGAATACAGAACAACATCGGTGAATTCTTCCGTGACG<br>TTGCCGAAGACGGTTACCGTTCGAAATCCACACAAGACTGAACCTGCAAGCGGTGACGGTAAA<br>AAGGTGAACTGCACCTGTTCGAAATCCACACAAAGACCTGTACTTCGACCGAAGACAAGCCGTGACG<br>TCTAAAACCACCCAGAAAAACTGCACACCCTGTACTTCGAATCTCTGTTCTCTAACGACAACGTTGTTC<br>AGAACTTCCCGATCAAACTGAACGGTCAGGCGGAAATCTTCTACCGTCCGAAAACCGTTACTCTGAAAACAAAT<br>CTTCTTCCACGTTCCGCTGACCCTGAACCGTAACAAAACGACTCTTCAACGCGCAGATCAAC<br>AACTTCCTGGCGAACAACAAGACATCAACATCGTTGTTGTTCTCTGAACGACTGTGAAAAACACCTGGTTTAC<br>TACTCTGTTATCACCCAGGCGTCTGACATCCTGGAATCTGGTTCTCTGAACGAACTGAACGGTGTTAACT<br>ACGCGGAAAACTGGGTAAAAAGCGGAAAACCGTGAACAGGCGCGTCGTGACTGGCAGGACGTTCAG<br>GGTATCAAAGACCTGAAAAAAGGTTACATCCTCCAGGTTGTTCGTAAACTGGCGGATCAAA<br>CACAACGCGATCATCATCCTGGAAGACCTGGAACATGCGTTTCAAACAGGTTCGTGGTGTATCGAAAA<br>TCTATCTACCAGCAGCTGGGTCACCTGCTGAAAGCGTACCAGTTCGTTCTGCCGCGTTGAAACCTTCCAGAA<br>AACCCGGAACAGGCGGGTCACCTGCTGAAAGCGTACCAGTTCGTTCTGCCGCGTTGAAACCTTCCAGAA<br>ATGGGTAAACACAACCGGTATCATCTTCTACACCAAACGACTCTTCACCCTCTAAATCTGACCGTTACCG<br>GTTGGCGTCCGCACCTGTACCGTTCGAATACTTCTCGAACTGACCAAAAAGCGAAAAGACATCGCAGGCGAAAG<br>CCAAAATCGAATTCGTTAACGACCGTTTCGAAAGTTGCTCTAACGTTACCGTTCCGTTGGACAAAACCTGA<br>AATACCGAACAAAACCGTTGGAAAGGTGTTACACCCACCAGATAGCACATCCGAAAACATCCAGGAACTGTTCACCCAAAT<br>ACGGTATCGACATCACCAAAGGTGTTACACCCACCAGATAGCACATCCGAAAACATCCAGGAACTGTTCACCCAAAT<br>TCTTCCCGTGACTTCATCTTCTACTTCAACCTGATCTGCCAGATGCCAGATCTGAACCGTTCTTCGACTCTCGTAAAGACAA<br>CGGAAAAACGGTAAAGACGACTTCATCGTCTGTCCGGTTGAACCGTTTTTCGACTCTCGTAAAGTATCGTTAT<br>CCTGAACAAATCGTCTCAGTACTCTGAAAACGTCGAAAAACTGCGAAAAATGCGAAAAATGAAATGGGGGTGACCTGT<br>ACGTTTCTAACATCGACTGGGACAACTTCGTT |
| SEQ ID NO: 51 | ATGGAAAAACTTTAAAAACTTATACCCAATAAACAAACAAAACGTTACGTTTGAACTGCGTCCATATGGTAAA<br>ACACTGGAAAACTTTAAAAAACGGTTTGTTGGAAGATGCATTTAAAGCGAACTCTCGCAGATCC<br>ATGCAGGCCATCATTAGGTAATGAAAATTTAAAGAGACGATCGAAGAACGTCGAAGAATTTAGT<br>GAGTGGACTTAGGTAATATGACTTCTAAAGATAAGAAAATCACCGATAAGGCGGCGACCAACCTGAAG<br>AAGCAGTCATTTATCTTTTGATGATGAAATCTTTAACAACTATTTGAAACCGACACAAAAACATCGATG<br>CCTTATTTAAAAATGACCCTTTGAATCGAATTAGCACATTTAAGGGCTTCACAACGTATTTTGTCAA<br>TTTTTTGAAATTCGTAAACATATCTTCAAAGGAGAATCAAGCGGCTCTATGCGCTCTATGCGATTATTGAT<br>GAAAACCTGACGACCATCAAGAAGTTGAATAACATTTGAAAAAACTACCAGTATTAGGTATAACGCAG<br>CACTATAATGAAAATTATTGCAGATATCAGTAAATCAGAAAATGTGAAAATCCAAGGGATTAATGAAGGC<br>ATTAACCTCTATTGCGAGAAAAATAAGTGAAACTGCCGAGGCTGACTCACTCTACAAATGATCCTG<br>TCTGACCGCGTCTCGAATAGCTTTGTCTGACACAATTGAAAACGTCGATAACGGATTGATTGAGAATGATA<br>AGCGATCGATTAACAAAACCGAAATTCACAGATGTAATCATGAGTGATATACAAACATCTTATT<br>AAATATAAACAGGTTGGTAATTCGTGCCTGGAATTAGCTATTCGTCAATAGTGAACGCAATCGTTCTGATT<br>ATGATAAACAATTTGCGACGTAAGCGTAAAAGAGTTATGAAAACGATAGGAAAAAACACCTGAA |

TABLE 6-continued

SEQUENCE LISTING

| SEQ ID NO: | Sequence |
|---|---|
| | ACTAACGTGTATTCTATCAACTATATCAGCGAACTGCTTACGGACCACCGATGTGAGTTCAAACATTAAGA<br>TGCCGTATAAGGAGCTTGAACAGAACTTACCAGGTCTGTAAGGAAAAACTTCAACGCCAACCAACTGGATGA<br>ACATTAAAAATATCAAACAATCCGAGAAGACCAACTTAATCAAAGATCTGCTGATATTTGAAGAGCA<br>TTCAACGTTTTATGATCTGTTCGATATCGTTGATGAAGACAAGAATCCTAGTGCGGAATTTTATACATG<br>GCTGTCTAAAAATGCGGAGAAATGGATTTCGAATTCAATTCTGTTTATAATAAATCACGCAACTATTTG<br>ACCCGCAAACAATACAGCGACAAAAAGATAAAACTAAACTTCGACAGTCCAGTTGGCAAAGGCTG<br>GGACCAAATAAGGAAATCATAACTCTACAAAGCACCCCGCCAACGAAAAGATAATTCCACTGGAGGATAA<br>TGATTATTCTTGAAAAATGCAGTACAAAATATATCCGACATCCAAGCAAGATGCTTCCAAAGCAGTTTCT<br>CGGTCTGTTCGAAAATTTGGAAAGCTAAGCATCCGACCACCCCAGAATTTGACAAGAAATATAAGGAAGGCGCCA<br>GTCTAAAATTTGGAAAGCTAAGCATCCGACCACCCCAGAATTTGACAAGAAATATAAGGAAGGCGCCA<br>TAAGAAAGGTCCCGATTTTGAAAAGAATTCTTGACGAACTGATTGATTGCTTTAAACATGGCTAGTC<br>AATCACGATGAAAAGTATCAAGATGTTTTTGGATTCAATTTGAGAAACACAGAAGACTACAATTCCTAC<br>ACTGAGTTCTCGAAGATGTGGAACGATGTAATTATAATCGAGCTTTAACAAAATCGCGGACACCTCG<br>AATCTGATTAACGATGGTAAACTTTATGTTTTCCAGATCTGGAGCCAAGGATTTCTCTATTGACAGCAAAG<br>GCACCAAAAACCTGACACCATTTACTTTGAAAGTCTCTCAGCGAAGAAAATATGATTGAGAAAATGT<br>TTAAACTTAGCGTGAAGCTGAAATATTCTATCGCCCGGCAAGCCTGAACTATTCGAAGACATTATCA<br>AAAAGGGTCATCACCACGTGAACTGAAAGATAATTTGATTATCCTATCATAAAGATAAACGCTATA<br>CCCAGGATAAATTTTTTCATGTTCCTATGGTCATTAACTACAAATCAGAAAAACTGAACTCTAAAG<br>CCTCAATAATCGAACCAATGAAAACCTGGCAGTTTACCCATATAATTGAAATTGATCGCGAGACG<br>TCATTTAATCTACCTGACCCGTAGTCGATGTATCGACCGGCAGATCGTCAGCACAAGCTTAGACGA<br>GATTATCAACACTGATAATGAACGTTGAGCATAAGACGCCATATCTAAACAAGCTGAAGGAGAAAATC<br>ATATCAGCCACGCTAATCAATGAAAATCAAAAATTCGAGGAAAAATAACATGCGCCCCTGATCGTTATGGAAA<br>ATCTGAATTACGGTTTCAAAAATTCTCAAGAAAATCTGGAGAAAATGGAAAAAGATCAGGTATATCGAAGTTCGAGACGG<br>CATTAATTAAAAGTTTAATTACATCATTGACAAAGAAATGGTAACCAGTCTGTGTCTTTACATCCCTGCTGG<br>GACGAACCCGATCACCACACCTGGATAAAATTGGTAACCAGTCTGTGTCTTTACATCCCTGCTGG<br>AATACCAGGAACAGGCCAAGTCTTTTATTCAACCTTCTATAGTATATCGATAATGGAGATAACTCAAATATAAG<br>AATCAGGAACAGGCCAAGTCTTTTTATTCAACCTTCTATAGTATATCCAGAAGAATGGACCGCTCACCTCGT<br>TTTGATATTGATTTTTCTAAATGAACAATCGTTATAGTATATCCAGAAGAATGGACCGCTCACCTCGT<br>ACGGAACCCGAATCCAGACATTCCGCAATCCGACAGAAGAACAATAAATGGACAGCGCCAGTATGAT<br>CTCACTGAAGAATTCAAATTGATTCTGAACATTGACGATGTTACCCTGAAAAGCCAGGATGTCGAAACCTAT<br>AAAAAATTTATGTCTCTGTTCAAGCTAGATCTGACGCCAACTCTGTGTACCGGCACTGATATCGATT<br>ATATGATCTCCCTGTCACTGATAAAACAGGTACCGCATTTCGATTCGCGCGAAATATCAAAATCTGCC<br>CGCAGATGCCGACGCCAATGGGCGCTACAATATTGCACGCAAGGGTATCATGGCGATCGAAAACATTAT<br>GAATGGTATCAGCGACCCGCTGAAAATCTCAAACGAAGATTATTTGAAATATATCCAAAACCAGCAGGA<br>ATAA |
| SEQ ID NO: 52 | ATGACCCAGTTCGAAGGTTTCACCAACCTGTACCAGGTTTCTAAAACCCTGCCGTTCTGAACTGATCCCGC<br>AGGTAAAACCCTGAAACACATCCAGGAACATCCAGGGTTTTCATCGAAGAAGACAAAGCGCGTAACGACCAC<br>TACAAGAACTGAAACCGATCATCCAGTCTATCTACAAAACCTACGCGACGTGCCTGCAGCTGGTT<br>CAGCTGGACTGGGAAAACCTGTCTGCGGCGATCGACTCTTACCGTAACGCTGACTTCATCGTGTACGAC<br>AACGCGCTGATCGAAGAACAGGCGACCTACCGTAACGCCGACTACTTCATCGGTCGTACCGAC<br>AACCTGAACGTCTGAAACGTCGGGTACCCGTTCAACCACCACCACCAGCAGAAAACGCGCTGCTGCGTTCT<br>TTCGACAAATTCACCACCTACTTCTCTGGTTTTCAGGACAACTTCCAGAAAACCGTAAAAACGTTTCTCTGCGGAAGACA<br>TCTCTACCGCGATCCCGCACCGTCCTGCCTCGTGAACATTCCAGAAAACGTTAAAAGCGATGTATC<br>TTCGTTTCTACCTCTATCGAAGAAGTTTCTCTTTCCCGTTCACAACAGCTGCCAAAACCAAGGTCGAA<br>CGACCTGTACAACCAGCTGCTGGTATCTGTGAAGCGGGTACCGACGGGAAAAATCAAGGTCGAA |

TABLE 6-continued

SEQUENCE LISTING

| SEQ ID NO: | Sequence |
|---|---|
| | CGAAGTTCTGAACCTGGCGATCCAGAAGAATCGCAGAAAAACGACGAAAACCGCGACATCATCGCGTCTCTGCCCACCG
TTTCATCCCGCTGTTCAAACAGATCTGTTCTGCAGATCTCTGACCGTAACAAAACCCTGCTGCCTAACGAAGAATTCAAA
TCTGACGAAGAGTTATCCAGTTCTTCAACGAACTGAACTGTCTGCAAATCAAAACCGTCTGCCAATCTCATCTCCACAAAAA
ACCGCGGAAGCGCTGTTCAACGAACTCTATCGACCTGGGACACCCTCGTAACGCGGTTCTGTACGAACGTCGTA
TCTCTGAACTGACCGGTAAATCACCAAAATCTGGGACCTGGAAAGAAAAGTTCAGCGTTCTGAAACACGAAG
ACATCAACCTGCAGGAAATCATCTCTGCGGGCACAGCGGGTAAAGATCTGTCTGAAGCGTTCAAACACAAACCT
CTGAAATCCTGTCTCACGCGGCGGCTGGACTCTTCTGCGGGACTCTGTACCACCTGCTGGATCGGTTCGGT
AAAAAGAAATCTAACGAAGTTGACCCGGAATTCTCTGCGCGTAACGCGGTATCAAACTGAAATGGAACC
GTCTCTGTCTTCTACAACAAGCGCTACTACGCGCCAAAAAACCTGTCTGTGAAAAATTCAA
ACTGAACTTCCAGATGCCGACCCTGCCGTCTGGCTGTGGCAGCTTAACAGACGTTAACAGAAAAAAACAACGGTCGAT
CCTGTTCGTTAAAACGGTCGTACTACCTGGGTATCAGCGAAAGGTTTGCACAAATGTACGACTACTTCCCCCGACGCT
GTCTTTCGAACCGGACGCAAAAAATCCCGAAATGTCTCACCCAGCCGGTTACGGCGGTGGAATATACACTCGAACCCG
GGCGAAAATGATCCCGAAAAGCGGTTCTACCGCAGCCCACATTCCCAGACCCACCAC
CCCGATCCTCTGTCTAACAACTTCATCGAACCGCGTACGCGGAAAGGTCTGGAAATCACCAACGAAATTACGACCTGAACAA
CCCGAAAAAAAGAACCGAAAAAATCCAGACCGTACGCCGAAATGCCGTGACCAGGTTACC
GTGAAGCGCTGTGACAAATGATCGATCGACGAAGCGCGGTCGTTCACCCGTGTCTAAAATACACCACCTCTAT
CGACCTGTCTTTCTCGCCGTCCGTCTACCACCAAGACCTGGGTGAATACTACGGCGAACTGAACCCG
CTGCTGTACCACATCTCTTTCCAGCGTATCGCGGAAAAGACTTCGCGAAAGGTCACCACCGGTAAACCGACCCTGCACACC
CTGTACTCGTTCCAGATCTACAACAAGACTTCTCTCCGGAAAACTGGCGAAACACTGGCTATCAACCTGAACGGCTCAGGGCG
GAACTGTTCTACCGTCCGAAAATCTGTATGAAACGTACCGTATGCGCACCTGGGTGAAAAATGCTGAAC
AAAAAACTGAAAGACCAGAACAGAAAATCCCGATCGTCTGACGAAGCGCGTCGTTATCAGGAGGACTGTACGACTACGTTAA
CCACCGTCTGTCTCTCACGAACCTGTCTGACGAAGCGCTGACAAATCTCTTCCAGTTCCACGTTCCGATCACCCTGA
TCTCACGAAATCATCAAAGACGCGTCGTTTCTGCCGTCTAAATTCAACCAAGCTGTTAACGCGGTTAACGAACCCCGG
ACTACCGGCGCGAACATCGGTATCGACCTGGGTTGAAAACCAAGCTCCTTGAAGGTTCGACTACCGTTCGTTTCGACGTTAA
AAACCCCGATCATCCGGTATCGAACGAATTCGTAAAACTCGTAAAATCGTAAACACTCGTAAAATCGTGACGTTAA
TAAAATCCTGGAACAGCGTTCTCTGAACACCATCCAGCAGCCTCAGTGTCGTTCTGTTGGTACCATCCAGGACAACCCGG
TGAAAAGAACGTGTTGCGCGCGTCAGGCGTGTCAGGCCGTCAAGAAATCGTTGACCTGAATCATCCAGGACGGGTCTGTACGACTGTTCTGGAA
TTACCTGTCTCAGGTTATCCACGAAAATCGTAAACGTACCGTATCGCGAAAAGCGGGTTTACCAGCAGTTCGAA
AACCTGAAACTTCGGTTTCAAATCTAAACGTAACGCAAACTGAAAAGGCCTGGTTTTACCAGCAGTTCGAA
AAAATGCTGATCGACAAACTGAACTGCCCTGGTTCTGAAAGACTACCCGGCGAAAAAGTTGGTGTGTT
CTGAACCCGTATCGACCAGCTGACCGACACCAGTTCACCCTCTTCGCGAAATGGGTACCCAGTCGTCTGGTTCCCTGT
TCTACGTTCCGGCCCGTACACCGTACACCTCTAAATCGACCCGTGACCGGTTCGTTGACTTCCTGACGTTAA
AACCATCAAAAACCACGAATCTGTAAACACTTCTGAGAAGTTTCGACTTCCTGCACTACGACCGTTAA
AAACCTGGACTTCATCCTGCACTTCAAATGAACCGTAACCGTAAATAACCCGCAAAAACGGAAACGGAAAGGTACCCGGGTTTTC
ATGCGGCGGTTGGGACATCGTTTCGGTTATCGAAAAACACCAGTTCGAACGGAAAGGTACCCGTACCCGG
GCGGGTAAACGTGATGCGCTGCGTAACGACACTTCGTTTTTCCGTGACGGTTCTAACATCCTGCCGA
CGAACGAGTGATCGCGTCAAACCACGACTCTCACGCGGATCAGACTACACTGCCGAAGCGCGCCAACCATCGAGAT
AACTGCTGGAAACGACGACTCACGCCGTTGCGATCCGGTTTCGTTCTTCTGTGACCTGAACGGTGTTTTG
GCGTAACTCTGCGTGCCCCAAAACTGAACGAAAACCGTGAACGACGCGAACGGCTACCACATCCTGCCGA
CTGAAAGGTCAGCTGTGCTGCTAACCACCTGAAGAAATCTAAAGACTGCAGAACGGTATCTC
TAACCAGGACTGGCTGGCGTACATCCAGGAACTGCGTAACTA |
| SEQ ID NO: 53 | ATGGCGGTTAAATTATCAAAGTTAAACTGCGTCTGGACGACATGCCGGAAATCCTGCGGGGTCTGTGG
AAACTGCACAAAGAAGTTAACGCGGGTGTTCGTTACTACCGGAATGGCTGTCTGCGTCTGCAGGAA
AACCTGTACCCGTCGTTCTCCGAACGGTGACGGTGACGGCTGAACAGGAATGCGACAAACCCGGAAGAATGCAA |

TABLE 6-continued

SEQUENCE LISTING

| SEQ ID NO: | Sequence |
|---|---|
| | AGCGGAACTGCTGGAACGTCTGCGCGCTCAGTTGAAAACCGTCACCGTGGTCCGGCGGGTTCTGA<br>CGACGAACTGCTGCAGCTGCGCCGCTGTACGAACTGCTCCGCTGGCGGACAACTGCTGTTCCCAGGCGATCGTGCGAAAGG<br>TGACGCGCAGCAGATCGCGCGTAAATTCCTGCTCTCCGCTGGGTTCGTATGCTGAAGCGGGTGAACCGGGTTGGTCTGGG<br>TATCGCGAAAGCGGGTAACAAACCCGTTGGGTTCGTATGCTGAAGCGGGTGAACCGGGTTGGGAAG<br>AAGAAAAAGAAAAGCGGAAACCCGTAAATCGCCGACCGTACCGCGACGTTCTGCGTGCGCTGGCG<br>GACTTCGGTCTGAAACGTCTGATGCGTGTTTACACCGACTCTGAAATGTCTTCTGTTGAATGGAAACCGC<br>TGCCTAAAGGTCAGCGGGTTCTGACCTGGAACAGATCAGTCCAGCAGTGTTCAGCAGGCGATCGAACGTATGATGT<br>CTTGGGAATCTTGGAACCAGCGTGTTGTCAGGAATACGCGAAACTGGTTGAACAGACTGGTCAGCAGGACAGAAAAACCGTTCG<br>AACAGAAAACTTCTTGGTCAGGAACACAGACATTGTTCACCTGGTTAACCAGCTGCGCAGGACATGAAAG<br>AAGCCTCTCCGGGTCTGGAATCTAAAGAACAGACCGCGACTACGTTACGCCTACGGCCTGCGTGGTT<br>CTGACAAGTTTTCGAAAAATGGCTGAAACTGGCGAATCTGAACTGGCGCGATCGGGGAAA<br>TCAAAAACGTTCAGCGCTGTGGCGCTGAAGAACCCGTCTGTTCGGCACACCGCGCGAAACTGGCCGAACC<br>GGAATACCAGGCGCTGTGGCGTGAAGACGGTCTTCTTCTGACCCGTTACGCGTTACAACTCTATCCTG<br>CGTAAACTGAACACCACGCGAAAATGTTCGCGACCTTCACCCTGCCGGACGTTCAACGAATTCGGTGAACGTC<br>ACCCGTTTCGACAAACTGGGTGTGTACAACTGCTGAAAGTTGAAAACGTGTTGCCGTGAAGTTGACGACGTTA<br>GTCACGCGATCCGTTTCACAAACTGCTGAAAGTTGAAAACGTGTTGCCGTGAAGTTGACGACTTA<br>CCGTTCCGATCTCTATGTCTGAACAGTCTGAACAGCACTTCACCGGTGGTGGGCGAAAATCCAGTGCCG<br>GTACTTCCGTGACTACGGTGCGGAACAGACATTCACCGGTGGTGGCGAAAATCCAGTGCCG<br>TCGTGACCAGCTGGCGCACATGACGGTGAAATGGGCGTGGCGTGCGTGACGTTTACCTGAACGTTTTCTGTTCGT<br>GTTCAGTCTCAGTCTGAAGCGCGTGGGTGACAGCGCGGGTTTTCCGTCTGGTTGGTG<br>ACAACCACCGTGCGTTCACTTCGACAAACTGCTGCACAACTGCTGCACACCGAACTGCCGGAACACCCGGACGACGGTA<br>AACTGGGTTCTGAAGGTCTGCTGTCTGGTCTGCGTGTTATGTCTGTTGACCTGGGTCTGCGCGGTCTACCTCTGCG<br>TCTATCTCTGTTTTCCGTGTGCCGTAAAGACAACCGAACTCTAAAGGTCGTCTTTACCTGACAGTTTCTCCGTTCT<br>TCTTCCCGATCAAAGTAACGACAACACTGCCTGCGTCGTTCGCGATCACGCTGCGAACACATCCAGGGCGATCCGT<br>GTGAAACCGAATCTAAAAGACTGGCCGACCGTCTATCATCATGGAAGCGCTGGGTTACGCTTTACGCTGACGAACTGGT<br>CCCAGCTGGCGTACCTGCGTCTGCTGGTTCGTGGTGCGGTTGGTGAACGCTTCCTGTTGGTGCCGCGTGACGGTTCTTG<br>GGCGAAACTGATCGACAGCCGGTTGAACCACATGAGCGAGACCGCCCGACTGGCGTGAAGCGTTCG<br>AAAACGAACTGCAGAACTGAAATTCTGCCGACTATCTGCTCTGACAAAGAATGATGACGCGGTTT<br>ACGAATCTTGTTCTCGTGTTTGCGCTCACATGCGTGAAGCGTTGGTGCCGTAAAGACGTTCTGAC<br>TGGTGAACGTCCGAAATCCGTGGTTACCGCGAAAGACGTTGTTGGTTAACTCTATCGAACAGATCGA<br>ATACCTGGAACGTCAGTACAAATTCCTGAAATCTTGGTCTTCTTCCGGTAAAGTTTCTGGTCAGGTTATC<br>CGTGCGAAAGTTCTCGTTTCCGCGATCACCGTTGAACACATGACGACCACGCGAAAGAAGACCGT<br>CTGAAAAAACTGGCGGACCGTTACTCATCATCATGGAAGCGCTGGGTTACGCTTGACGAAGACTGTCTGAATACCAG<br>AAAGGTAAATGGGGTTGCGAATACGCCGGTGCCAGCTGATCCTGCTGAAGAACTGTCTGAAGACTGCGTCACCGGTGGTCTCCACCGGTCTCCAGG<br>TTCAACAACGACCGTCCGCCGTCTGAAACAACCAGCTGATGCGAGTCAGTGTTGTACCATGTACGGCGGGTTCTCTTCTGTTT<br>AACTGATCAACCAGGCGCAGTTCACGCTGTTGGTACCAGTCTGAACACATGCCAGCACACCGCGAAAGACCGT<br>CGTGCGAAAAAGGTTCTCTGTTTCCGCATCACCGTTGAACACATCAGCCACACCGCGAAAGACCGT<br>CTGAAAAAACTGGCGGACCGTTACTCATCATCATGGAAGCGCTGGGTTTACGCTTGACGAACTGGT<br>AAAGGTAAATGGGTTGCGAATACCCGTGCCAGCTGATCCTGCTGAAGAACTGTCTGAATACCAG<br>TTCAACAACGACCGTCCGCCGTCTGAAACAACCAGCTGATGCGAGTCAGTGTTCACCGGTGTCTCCACCGGTCTCCAGG<br>AACTGATCAACCAGGCGCAGTTCACGCTGTTGGTACCAGTCTGAACATGTACGCGGGTTCTCTTCTGTTT<br>CGACCGCGCGAACCGTTCCCGTGGTGGCTGGACCGGTGGCGTGACCAGCCAGAACCTGCCTGTTGCACCCAGGAACACAA<br>GCGAACCGCCCACCGGTGATCCCGACCGGTGGCGTGACCGGCGTGACCCAGCCAGAAGGTGAC<br>TTCCACCAGATCACGCGGGTAAAACGGCGTAAAACGGCGGTGGACCGGTGGCGTGACCCAGGAAGGTGAC<br>ATCTCTCAGATCCGCGCGAGAAGCGCGTAAAAATCGTGTTCTATGATGCGTGGTTTTCTGATGCCTGCTGGTTATCATCA<br>CCGGTAAACGTAACGACCGCGCAGACTCTTACTCACTCCTAAAGTTTTCCGCAGGGGAAAATGGGTGAAGCGGAAC<br>ACGTGAACGTGGTAAAACGTGGAACGCGAAAACGTGTAAAGTTCAAATGGACTGCCCCAGGAAAACAACCGCGGAAC<br>TGCTGGGTTGAAGCGGACGAAGCGGCGTAAAAATCGCTGATGCCGCGCCGCTGTGGTCATCATCA<br>ACCGTGGTAACTGGACCGGTGGCGTGAACCCGTCAGAAGAATTCGTCTATGGTTAACCAGCGTATCGAAGGTTACCTGG<br>TTAAACAGATCCGTTCCGTTCTCGTTCCGCTGACTCTGCCGTGCCGAAAACACCCGGTCGACATCTAA |
| SEQ ID NO: 54 | ATGGGCGACCCGTTCTTCATCCTGAAATCGAAAATCGAACCGGAACCGAACCGAAGAAGAAGTTAAAAGGTCTGTGGAAAACC<br>CACGGAAGTTCTGAACCACGATCGCTACGTATCGGCTACTACATGCGAAACTCCTGAAACTGATCCGTCAGGAAGCGATC |

TABLE 6-continued

SEQUENCE LISTING

| SEQ ID NO: | Sequence |
|---|---|
| | TACGAACACCACGAACAGGACCCGAAAAACCCGAAAAAGTTTCTAAAGCGGAAATCCAGGCGAACT |
| | GTGGGACTTCGTTCTGAAAATGCAGAAGAATGCAACTCTTTCACCCACGAAGTTGACGAAGACGTTGTTTTC |
| | AACATCCTGCGTGAACTGTACGAAGAACTGGTTCCGTCTTCTGTTGAAAAAAAGGTGAAGCGAACCAG |
| | CTGTCTAACAAATTCCTGATCCCGCTGGTTGACCCGACCTCTCAGTCTGTGGTAAGGTACCGCGTCTTCTG |
| | GTCGTAAACGCGTTGGTACAACCTGAAAATCGCGGGTGACCCGTTCTTGGGAAGAAGAAAAAAAAAA |
| | TGGGAAGAAGACAAAAAAAAAAGACCCGTTCATCCGTTCCACGACTTAACGATCGTTAAAGAAATCCTGGGTAAACTGGCGGAATACGGTCTGAT |
| | CCCGTGTTCATCCGTTCCACGACTTAACGATCGTTAAAGAAATCAAATGGATGGAAAAATC |
| | TCGTAACCAGTCTGTTCGTCGTCTGGACAAAGACATGTTCATCCAGGCGCTGGAACGTTTCCTGTCTTGG |
| | GAATCTTGGAACCTGAAAGTTAAAGAAGAATACGAAAAAGTTGAAAAAGAACACAAAACCTGAAGAA |
| | ACGTATCAAAGAAGACATCCAGGCGTTCAAATCTCGGAACAGTACGAAAAAGAACGTCAGGAACAGC |
| | TGCTGCGTGACACCCTGACCACTCAACGAATACGTCTGTCTAAACGTGGCGTGACGTTGGCGTGAAA |
| | TCATCCAGAAATGGCTGAAATGCACCCCGTGAAGCGGGTGACTACTTCTGTTTACGAATTCCTGTCTAAAAAGAAAAAC |
| | ACCAGCGTAAACACCCGTGAAGCGGGTGACTACTTCTGTTTACGAATTCCTGTCTAAAAAGAAAAAC |
| | ACTTCATCTGGCGTAACCACCCGGAATACCCGTACCCTTCTGCGAAATCGACAAAAAAAAA |
| | AAAAAAGACGCGAAACAGCCAGGCGACCTTCACCCTGGCGACGAATCTATCGAAGTACCACCCCGTGTGAAAGGTAC |
| | TCGAAGAACGTTCTGGTTCAACCTGAACAAATACCGTATCCTGACCAGTCTGGTGGTGGGAAGAAA |
| | TGAAAAAAAAACTGACCCGTTCAGCTGACCGTTCTGCCGTTCGTCAGTTCTACACAAACAGATTCTCCGGAAGATCCTGAAGA |
| | AAAAGGTAAACACCGCGTTCCACGTTCACCTCAGAGGTGAATCTATCAAATTCCCGCTGAAAGGTACCCTGGGTGG |
| | TGCGCGTGTTCAGTTCGACCGTGACCACCTGCGTCGTTACCCGCCACAAAGTTGAATCTGTAACGTTGGT |
| | CGTATCTACTTCAACATGACCGTTAACATCGAACCGACCGAATCTCCGTTTCTAAATCTCTGAAAATCC |
| | ACCGTGACCACTTCCCGACACACACTTCGTTAACTTCAAAACCGAAAGACTCTACCAGAATGGATCAAAGACTCTA |
| | AAGGTAAAACACGCGTTCCAGTTGTATCGAAATCTCTGGAAATCCTGCCGTTGTCGTCTATCGACCTGG |
| | GTCAGCGTCAGCGGCGGCGGCGTCTATCTTCGAAGTTGTTGACCCAGAAACGGACCATGCGAAGGTAAAC |
| | TGTTCTTCCCGATCAAAGTACCGAACTGTACCGGTTGCGTGTGCTCTTTCAACATCAACAAACTGATGAACCA |
| | GAAACTGGTTAAATCTGAAGTTCTGCACTTCAGCAGTTCCGCTGGTTTACCAGGACGAACAGCAAAACG |
| | TGTTACCAAATGGATCTCTAGCAAACCTGTACGTTCGCGTGGTTGCGCTGGTTACCAGGACGAACTGATCCAG |
| | ATCCGTGAACTGATGTACAAACCGTACAAAGACTGGGGTTGCGTCAAAAACTCTGTTCCGAAAACGTCCACAAACGTCTG |
| | GAAGTTGAAATCGGTAAAAAGAAGTTAAACACTGGCGTAAATCTGTCTGACGGTCGTAAAGGTCTGTAC |
| | GGTATCTCTCAGAACATCGACCAAAATCGACCCTACCCGTAAATTCCTGCCTGCGTTTGGTCGTCTGCGTC |
| | CGACCGAACCGGGTGAAGTTCGCTGTCGATCGAAATCTGCAGGTTCTGCAGGTCGAAGTTGGTCGCA |
| | TGAAATCCCGCGCTGAAAGAAGACCCGTAAATCGCGAAAAATGGCGAAAACCCGGCGTGCGAAAACCATCCTGTTCGAAGACC |
| | GCTACGACGTTCGTAAAAAATGCAGGCGAAAACGTTCTGTTTCAGAAGGTGAAATCGCCCGTAAATGTCTCGTCG |
| | TGAAATCTCAACCCGTACAAGACACGGTCCTGGTTCAGGGTGAAATCTGCAGGTTCGCAGGTTGTGCGCA |
| | GTTCTCTCTCGTTCCACGCAGAAAAACCGGTTCCCGGGTATCGTCTCCGGGTTATCCCGCGTGTTCTTGGTTACCAAAGACCGGTT |
| | CTGCAGGACAACCGTTTCTTCAAAAACCTGACCGACAAAGGTGAAGCTGTCTGTCTGACCCTGAAAGACCGGTT |
| | CTGAAAGAAGGTGACCGTGACCCCACGGGACATCAACGCGGACAAAGTTGACCGTCAGAAAACGTTCTGACCCGTACCAC |
| | GGTTTCTACAAAGTTTACTGCAAAGCGTACCAGGTTGACGGTCAGACGTACTTCATCTAAACATCCCGAAATCTAA |
| | GACCAGAAACAGAAAAATCATTCGAAGAAATCAAAAGTTCTCTAAACAGTCTTCTTCTGAACAGCGTGTTTTACGAA |
| | TGGGGTAACCGGGTAAACTGAAAGACTCTTTCCACTTCGCCGTTCGAACTGAAGGTTGAAAAAACTGATGCTGTACCGT |
| | TCTGACATCCTGAAAAGACTCTTTCCACTTCGCCGTTCGAACTGAAGGTTGAAAAAACTGATGCTGTACCGT |
| | GACCCGTCTGGTAACGTCTAAACTGCTAAACTGGATCGTTTCCCGTCGACAAATGATGGCGCGGGTGTTCTGGTAAACTGGAAC |
| | GTATCCTGATCCTTAAACTGACCAACCAGTACTCTATCTCTACCGAAGACGACTCTTCTAAACAGTC |
| | TATGTAA |

TABLE 6-continued

SEQUENCE LISTING

| SEQ ID NO: | Sequence |
|---|---|
| SEQ ID NO: 55 | ATGCGACCCGTACCATCAACCTGAAACTGGTTCTGGGTAAAACCCGGAAAACGCGACCCTGCGTCGT<br>GCGCTGTTCTACCACCCGTCTGTTAACCAGGCGACCAAACGTATCGAAGAATTCCTGCTGCTGCC<br>GTGGTGAAGCGCTACCGTTGACAACGAAGGTAAAGAAGCGGAAATCCCGCGTCACGCGGTTCAG<br>GAAATCCTGACGTTCGGCGACGCTGGCCTTCGCCTCAGCGTCTGTTCCGTGCATCTCACCTACGAAGACCAG<br>GGTGACGCGCAGGCGCGACGTGGGTTTCTCCGGAATCTGAAGGTGGTCTGTCT<br>GTTTACGACAAAGTTCTGACGCCGCCGTTTGATGAAACTGAAAGAAGAAAAAGCCCGGGTTGG<br>GAAGCGGCGTTCTCAGATTCTGGATCCAGTTCTGACGAAGGTCAGTCTCTGCTGAACAAACCGGGTTCTCCG<br>CCGCGTTGGATCCGTAAACTGCGTTCTGCAGCCTGGCCAGGACGACTTCGTTTCTGACCAGAAAAA<br>AAACAGGACGAACTGACCAAAGTAACGCGCTGTATCAAACACGTGAAAGAAATGGGTCTGCTGCC<br>GCTGGTTAACCCGTTCTTCCGTCGTTCTGCTCACCTGCCACTTCATCTCTTGGAAGTGTTTCCGGTGGGACCGTCTG<br>GCGGTTCGTGCGGCGGTTGCGCATCAGCGGCGTCGTGCGCGCGATTCAAGAAGCGACTTCACCCTGC<br>ACTCCTGAAACTGCGCCGCTCGTGACGAATCCGAAGCGGCGTCTGACAGAATTCAAAGACGACTTCACCCTGC<br>TGCGTCAGTACGAAGCCGCAAACGTCACTCTACCCTGAAATCTATCGCGTCGGCGACGACTCTAACCCGT<br>ACCGTATCCGTGTGTTCGTTCCTGCCGTGGAACCGTGTTCCGTCGTCGTGAACGGATCGACAAAGGTCGA<br>CCGAAGAACGCGCGTTGGTTGTACCATCCTGTCAATCAGAACGTGGTCGTGGTAAATCGGTGACCGG<br>ACCTGTTCAACTGGCTGGCCAGGACCCGTTCACGTTCACCTCTGTGGTCTCTGTTACCCGCT<br>GGTTCGTATCGACCGGTTGACAAAGTTCTGCCGTCGTCGTAAACCGTACGCCGTGATGACCTTCCGGCAC<br>CCGCGTTTCACCCCGCGTTGATCTCGTAGAAGCGCCGGGTGGTTCTAACCCTGCGTCAGTACGCGCTGG<br>ACTGCACCGAAAACGCGTCGTCCACATCACCCTGCCTCGCCGTCTGGTCAGATCCAGGACCTGCCGTCGACCCTGAATTCGGTGACCGG<br>AAAAAAAAATCCGGTGTTCCGCTGCGCACCGTCTGGTTCAGATCCAGGACCTGACCCTGGAAAAACTGGAAA<br>GGTTCGTATCGACCGGTTGACAAAGTTCTGCCGTCGTCGTAAACCGTACGCCGTGATGACCTTCCGGCAC<br>CCGCGTTTCACCCCGCGTTGATCTCGTAGAAGCGCCGGGTGGTTCTAACCTGCGTCAGTACGCGCTGG<br>GGTTTGGTTCAAACTGACCGGACGTTGCACCACTTCAACCAGGCGCCGAACTGGCTGGACGTAAAGGTCG<br>TGTTCGTACCCCGCCGAAGTTCACCACTTCAAAACGCCGTCTCAACAATCTAAACACACCCGTACC<br>CTGCAGCCGGTTCGCCGTGCTGCGCGTTCCGCCGTGGCCGGACCGAGTATGCGGACGAAGTTCTATGGACTCTCC<br>ACTGACTGAAGCGGGTAAACCAGACGTTCTTTCAAACTGACCCTGCCGGGTGAAACCCGTCTCGTAA<br>GAACAAACTGTGGGCGAAACACGAACGTTCTATCGCGTGCGAAGAACACGAGTCTACGCGCGTGAAGGTGACATCCAGCGTCTGAA<br>AGAAGAAGAAGAACTTCTATCGCGGCGTGCGAAGAAGACAACGACAACCGTCGCTGAAGACGTTCTTCAA<br>AGGTTGGGGTGAAAGAGCGTTGTTCCGGTCAGACGGTTCCGCCGCTTCTCGTCTCAGGGTCTGGGTGCG<br>GCGCCGTTCCGTTCACCCCGGAACTGTGGCGTCAGCACTGTAAACGGAACCCGTCAGAACGTAAAGCGAAGCG<br>TGCCTGGCGAAACACATCTCTGACTGGCCGTAAATCTATCTGGATGCGGTAAATCCTGGGACGCCGGTTGCTGAAATGGTGAT<br>ACAAAACCCGTTCTTACCACGGTCTGCGTGGGTCTACGGTGCGATCAGGACCACCGCCGGCGGTTCGGT<br>GCTGCGTTCTCTGGTCTCGCGGTCTACGGTGCGATCAGGACCACCGCCGGCGGTTCGGT<br>TCTCTGGCGTCTCGTCGTGCTGCCACCAATCAACTCTGCCGACGGTAAAGGAAGACCCGTATCAAAACCGGTCGGACT<br>CTATCGTTCAGGCGGCGTGATCCTGTTCGAAGACCTGCGGCGTCGATCTGCGGTTACCCGTTCCGCCGTCGTGAAAA<br>CGTGCCAGCTGATCGTGCAGGAACCGCATCATGGGAAACCACCACCATGCAGGCGGAACGTCTACGG<br>CTCTCACCGATGCGATGGCAGTCGACTTGCGTGCGAACGTCAGCAGTTCGCCAACCTGCAGCGTCCTGGTCGTCGTTGCGGTGTT<br>TCAGATCGTTGAAACCCGGCGGGTTTCTCTGCAGAAAGTTGAATCTGAAGAAGAAAAACTGGTCGTGCTCGTCTGAAAAAATCC<br>CGTTGCCGTTTCGCCGTGGACCGTTTGAATCTGAAGAAGAAAAACTGGTCGTGCTGTCTGAAAAAATCC<br>CTTGGATGCTGGGTTAACAACCAAAGTTGAATCTGAAGAAGAAAAACTGGTCGTGCTGTCTGAAAAAATCC<br>GTCCGGGTTCCTGGCGCAGCAGCGTCAGCGCCCCGCCGAAACGTCAGACCC<br>TGTGCGTTATCCGTCGGTTTGCAGCAGCGCATGAACGCGCCACCGTGACGACGACGAAACCTGCAGCGTTCTCGCCGCTCGTCTGGCGCTCTACCCCGGGTGCGCGT<br>AGCGTTCCGTCTGTTCGCGCAGCAGCGTCAGCGCCCCGCCGAAACGTCAGACCC<br>ACCTTCAGATGAACCGTTTCGTTAACAACCGTTCGGTTAAAAAATCAAACCGCCTGCAGACAAC<br>AACGGTGACCGACGACTGGAAGACTTCTGTTCTGCCGAAGAGACGACCGGTCGTATCACC |

TABLE 6-continued

SEQUENCE LISTING

| SEQ ID NO: | Sequence |
|---|---|
| | GTTTTCCGTGACTCTTCTGTATCTTCTCCCGTGACAACTTTGATCCCGGCGAAACAGTTCTGGCCGC |
| | GGTTCGTGCGATGATCTGGAAAGTTATGGCGTTCTCACTCTCTGGGTTAA |
| SEQ ID NO: 56 | ATGACCAAACTGCGTCACCGTCAGAAAAAACTGACCCACGACTGGGCGGTTCTAAAAAACGTGAAGTT |
| | CTGGGTTCTAACGGTAAACTGCAGAACCCGTCTGATGCCGTGAAATGCCGACGGTCGTAAAAACATGTTC |
| | CGTAAAGCGTTCTCTGCGTACGCGCTGGACCAAAGGTGAAATGACCGACGGTCGTAAAAACATGTTC |
| | ACCCACTCTTTCGAACCGTTCAAAACCAACCTCTCGTCGACCACGAGTGCCGACAAAGCGTAC |
| | CAGTCTCTGCACTCTTACCTGCCGGGTTCTCTGCGCACTTCCTGCGTCTGCGCACGCGCTGGGTTTCCG |
| | TATCTTCTAAATCTGGTGAAGCGACCGCCGTTCAGGCGTCTCTAAAATCGAAGCGTACGAATCTAAA |
| | CTGGCGTCTGAACTGGCGTGCGTGCGTTGAAGGTGAAGAAACCTTCTGCGGAACCTGACCATCTCTACCCTGTTCAACGCGC |
| | TGACCACCTCTGTTCGTGATGCGTAAAGGTGAAGAAACCTTCTGCGGACCCCGTTCTACACCCT |
| | GCTGACCGGTAAACCGCTGTCTCGTGACACCCAGGGTCCCGAACCTGACCTGGCCGAAGTTATCTCTG |
| | TAAATCGCGTCTTCTTTCGGTAACTGGAAAGAAATGACCGGAACCCGCTGCAGTCTCTGCAGTTCTTC |
| | GAAGAAGAACTGCACGCGCTGGAACCGGAATCGACCCATCGTTTTCGACCGGCGCGGCGGTTTTCGAATAC |
| | AACGACCTGCAGGGTGACCTGAAAAACGTTTCGACCGGCGCGCGGTTTTCGAATAC |
| | AACGCGGAAGACCCGGCAGACATCATCAAACTGAACCCGCGTTACGCGAAAGAAGCCGTTATCAA |
| | AAACCAGAACGTTGTAACTACGTTAAAAAACGCGATCACCAACACCCAACCGAACGAACGGTCTGGGTTGGCT |
| | CGTTCTCACCCGTCTTGCCACCGCGTGATCGAACTGATCGCGCAGCTGGAAGCGCCGAACTGTTTCGAA |
| | AAAACGTTTCTGTCTCTTCTCTGACACCCGTTCTGAAGTTCAGGGTATGATGATCGACTCTGAAGAACTGCTGAACGCTCTGAATCAATCTTTC |
| | CGCGTCTGTCTCTTCTCGCCACTCTCTCTCGTGTTCATCGGCACGGTGCCAGTGCTCGACACCCGGTCTGGAATCTTCGCACGTCTGC |
| | CGAGCGCCTCGCAGTCTGGTTTAACTGCTCGCGAACATCTGCGCGGTTCGCCAGTACGATGCTGACCAA |
| | CTCTTCTGGTTGAAGAATCTATCGCGACCAAACGTAAAGCGATGACCGATCGACGGTGAAAAAATCCACCTGTCTGTGTT |
| | GCGGGTCAGATCAACGGTGCGATCAAACGTAAAGCGATGACGGTGAAAAATCCACCTGCCGGCGGC |
| | GTGGTCTGAACTGACTGCTCTCTGCCGTTCATCGGTCAGCCGGTTATCGACGTTGAATCTGACCTGGCGAC |
| | CTGAAAAACCAGTACCAGACCCGTCTAACGAATTCGACCACCTGATCTCGCGTGCGAAAAACTTC |
| | GACCGAACTTCAACAAAGCGTCTGAACTGCTACCAGCACTTCGAAGGATGTGCCGTTCTACCAAA |
| | AAAACGCGCTGTCTAAACCGGAAATCGTTTCTTACCGTGACCTGCTGGCCGCGTCTGACCTTCTTGCCTGT |
| | ACCGGTGGTTCTCTGGTTCTGCGTCGCGACTAAACAAACACTTCGTTTCGTTTCTCCGCTGACCGTAAAGCG |
| | CTCTGAACTGCGTCAGAACACGTTCAACGAACTGCTGACCTCTGCTGCTGCTGCTGCTGATCTGCACGTTATCGACGAAATCCTGCAGCAC |
| | AAAAAACTGCTGTCGACTCGCTCTGTTCTGTCTGCACGTTATCGACGAAATCCTGCAGCAC |
| | GACAACCTGGAAAACAAAGACCGTCAATCTCGTGGCCGTCATCAACCTGCCGATCATCACCCAGAAAGGTGACGTCTGTCTGATCGA |
| | CGGACCAGCTGTCTTCTTCTCGCCGATCATCAACCTGCCGATCATCACCCAGAAAGGTGACGTCTGTCTGATCGA |
| | CCTGATCCAGTACGACCAGGATCAACGGAACAACAGTCTTTCGTTGTTACCCGTACCCTGCCGTCAAATCTAAC |
| | CTGCTGGTCGCAGTACCGGTCAGATCAACAAACAGTCTTTCGTTGTTACCCGTACCCTGTCTCCGTACCTGG |
| | GTTCTAAACTGGTTTACGTTCCGAAAGACAAAGACAGACTGGCTGGCGGCGGTCGTCTGCGTTCGAAGGTCGTTTT |
| | CGCGGACATCCTGTAACATCTAACATCGTTTCTCTTCTGGAAGACGCCGGGGTTCGCGGCGTTCGCCGTGAACTG |
| | GAAACACCCTGTCTAACATCCAAGACCGAAATCGTGTGTCTGGGTGTTAACGTTGACGTATCTGGTTCACA |
| | CCCACCAGTCACCTTCAACCAGATCCGTGATCACTGTAAAGACGTTAAAGTTAACGTATCGCCGTCAACA |
| | ACGGTGACATCCCGTCTGAAAAACCTTCTGAAAGGTGTAAAGTCTCCCGCGCTATCCAGTTCGAACGT |
| | TCTGTTCAGACCCTGAACCGTTGGTCAAGGTGTAAAGTCCGCGCTATCCAGTTCGAACGT |
| | GCGTACTACAAAAAAGACGACCAGTTCCACGAAGACGCCGAAACGTAAAATCCGTTTCTCAGATGCC |
| | GGCGACGACTGGTTCACCCGTTCACCACACTCTCGGTTCTACCCGCTCTTACCCTGTCTGGGTATCGACCC |
| | GGGTGAATACGGTATGGGTCTGTCTCGTCGGTTTCTTATCAACAACGTGAAGTTCGACTGCTGTTTCATC |
| | CACATCAACTCTCTGATCAACTTCCGTCTAAAAAATCTAACAACCAAGAACCAAAAGTTGTTCGCGTCAGC |
| | AGTACAAATCTCGTACCGCGAACTACCTGGAACAGTCTAAGACTCGTAAAGACTCTAACCGTCGGTGCATGCGCACA |
| | TCCTGACCCGTGATCTACAAACGAACGCGCGCGCGTTTTCGAAGGCGCTGTCTGGTAACTCTCAGTC |
| | TGCGGCGGACCAGGTTTGGACCAAAGTTTCTGTTTCTTTCTACACCTGGGTGACAACGACGCAGAACTC |

TABLE 6-continued

SEQUENCE LISTING

| SEQ ID NO: | Sequence |
|---|---|
|  | TATCCGTAAACAGGACTGGTTCGGTGCGTCTCACTGGGACAATCAAAGGTATGCTGCGTCAGCCCGAC<br>CGAAAAAAACCGAAACCGTACATCGCGTTCCCGGGTTCTCAGGTTCTCTTACGGTAACTCTCAGCGT<br>TGCTCTTGCTGCGGTCGTAACCCGATCGAACAGCTCGGTGAAATGGCGAAAGACACCTCTATCAAAGAA<br>CTGAAAATCCGTAACTCTGAAATCCAGCTGTTCGACGTTACCATCAAACTGTTCAACCCGGACCCGTCTA<br>CCGTTATCGAACGTCGTCTCACAACCTGGGTCCGTCTATCCGGTTGCGGACCGTACCTTCAAAA<br>CATCTCCCGTCTTCTCTGGAATTCAAAGAACTGATATATCTCGTTACTGCTGACTCAACTCTCT<br>AATTCATCGCGAAAAACGTGGTATCGGTTCTGAATACTTCGCGTATCTGACTGAACAACTCTTCT<br>GAACTCTGAAGCGAACGCGGCGCGAACGTTGCGCCGAACTGCCAGAGAATTCCAGAAACAGCTGTTCTTCGAACTGTA<br>A |
| SEQ ID NO: 57 | ATGAACGTATCCTGAAACTCCTGAAAGTTGCGGCGTCTGAAAGTTCTGGTAAGGTTCTGAAC<br>TGGTTAAAACCGTTAAATACCCGCTGGTTTCTCCCGCTTCAGGTTGCGGTTGAAGAACTGGCGAAGCGA<br>TCCGTCACGACAACCTGCACCTGTTCGGTCAGGAGAAATCGTTGACTGATGGAAAAGACGAAGGTA<br>CCCAGGTTTACTCTGTTGACTTCGGTGACTGGACACCCTGGGTATGTTCTTCTCCGTCGCG<br>AACGCGTGAAATCACCCGGGTAAATTCAACCTGACCAGGTTCTCCGTTCCGTAAAGTCTGAAC<br>AGTCTCCGTTCTTCCTGGCCGGGTCGTCTGAAAGTTGAACGGCGCGAACGTATCCGTCGTTGAAATCCG<br>TAAAATCGGTAAACGTGAAAACCGTGTTGAAAACTACGCGCGGACAGTTGAAACCTGCTTCATCGGTCA<br>GCTGCTGTTCTGACGAAAACAGTCTATCCAGAACTGGCTGAACGGACATCTGGGGACTTCTAAAGACCACGA<br>AGAACAGCGTATGCTGAAAGCGACTTCTTCGCGATCCCGCTGATCAAGACCCGAAAGCGGTTACCGA<br>AGAAGACCCGGAAACGCGCGGGTAAACAGAAACGGATCCGTGGAACTGTGCGTTGGTCCG<br>AACTGTACACCCGTGGTTTCGGTTCTATCCGGAAGACTGCCTGGATCGTTGGTATCGACTCTGCTGACAA<br>AATGTCTCTCTGCTGACACCGGAAGACTGCCTGGAATATACCGTTGGTATCGAACAGATCTTCCAGTTCAT<br>TGAACTCTCTGCTGGGTACCTTCTGCAGGGTAAAGAACAGAACGTTCTCGCTGAACTCTGCTGCGGA<br>GCTGGGTTCTTACGTGGTTGGCAGGTAAAGCAAATTCGCGGGTAAAGAAGAATCGCGGGTAAAGATCTCCACCGG<br>AAAAGTTAAACGTCTGCCGAAACGAAATTCGCGGGTAAATGCGCGGATGCCGCGGAGAAATCGCG<br>TCAGCTGACATCCAGCACGGCTAAACTGATGAAGAACCAGCAGCTGAATCGCTTACTTGAAGAAAAAAGGGTGGTTACCACCGCAG<br>AAATCGACATCCAGCACGGCTAAACTGATGATGAACAGCAGCTCGCGCGCTGCGTAAACGTGAAGAAAAAGGTGGTTACCACCCGCAG<br>CTGCTGTCTCAGTACGTAAACTGAAGCGGTCGTCATCATGAAGCGGATCGCCCGCGCTGATCACATAATCTGTTGCGGGTTTCC<br>ATCGAAATGACCCACAGTCTCTGAATCTCGAAGCGCGTTCGTTCTTCTTACATCATGATCCGTGATTCGATTCTCTGCGTGCGTAT<br>TGCCCGACCTGCTGACAAAATCGACACAAAACTGTTCGCGTAACTCGTGGACCGTGACAAGACCCGGAACGTTCCCGCGTTTCATGGC<br>CCCGAAAATCGACAAAATCGACAACAACGTTCGACCACCGTTTCCGGAAGGTT<br>ACCTGTTCACCGCGAAGACGTTCGACCCGTTCGGTAACTTCCTGTAACTTCGGTGAAAACCCGGACGGCGTTCCCCGTTTCATGGC<br>GGAACGTATCCGGAAGACTGGACCCCGTCTAACCTGTAAAAACCCGAACACCGTCGGGTATGGTTAAACA<br>CGTCAGAGAAGTTGTTAACCAGCTGGTTGAATCTCCGGGTGCGCTGTACCAGTTCAACGAATCTTTCCTG<br>CGTCAGCGCGTCTGCAGGCGATGCTGACGCGTTTACAAACGTGACCTGACCGGTTCCTTGGCGATGTGAACCTG<br>CTGGCGGACGTTTGCGCTCGCTGTGACTTCTTCCGGTCTGGGGTAACGACACATCATCTTCAAATCTT<br>GCCAGGAGACCCGCGTAAACAGTGGCAGACGCACCGTTATCCCGCTGTCTCTTCCCGGACGTTTACACCGGT<br>GCGAAGGTCTGGCGATCCGTCGTGCGGACGAACCCTGGGTTCGAATGAAAAACTGAAAGGTCACGAAC<br>GTGAAGACTTCCTGCGCTGTGATGAACAGCGTGAATACGTTGAAGGCGTAAAGCGATCGA<br>TGTTAAACTGGAAGACTTGGAAGACTTGAACAACGCGGTAATACGTTGAAGGCGTAAAGCGATCGA<br>CCCTGCCGCTGGAACTTCGGCGTCGCGCTGGAAGTTCCGATCTCCTGAAGTTCCTGAACGGTTACCTGTTCTGAACTGCGTC<br>AGCTGGAACTGCTGCTGCGTCCAGCTGGTTCGTAAATCGTTATGACCCGTCGTTCTGTAAAACCACCGGTTCTCCGAA<br>CCGTCGTCTCCAGCTGGTTACCTGCGCTACCTGCGCCGGTTCGACCCGTCGACCGTGCGGTTCGCGG<br>CAGGAACGTCGTGACCGACCCGACCCCGGTTACCAGGAACTGAAAACCATGCGGGTTCTCTTCTACGACCCACCTGTTCG<br>GTAAACTGCTACCACCCCGGACCCCGGTTACCCAGGAACTGAAATACCGGCCGGTTTCGTTCACGACCACCTGTTCT<br>GTTTCAAACTGCCCGGCAAACCTGGCGGCGATGTCTAACACTAGCTGTTTGAAACCGTGAAATACCGGTTCGAAGTTCGAACGGATCCGCCACCGGT<br>GCGAAACCGAAAAAAGGTGTTTGCGGCCGGAACTGTCCGCACCCCGGTTTCGAAAGTTCGACCGTACGTACGACCGACACCCCGGT<br>TTTCGGTTCGTTCTTCGGCGAACTGGCCAGTGTCGTTTCTTGTTGCCGAGACACC<br>CCGCTGACCATCGAACTGGCGGAAACCTCGTTCTTCTTGTTGCCGTTCGACCTGAA |

TABLE 6-continued

SEQUENCE LISTING

| SEQ ID NO: | Sequence |
|---|---|
| | AAACCTGACCACCATCCTGGCTCTGTTGTGTGAATTCCGTTGTTACCGCGGACCAGCCGTTCAAACTGACC |
| | CCGATCATCCCGGAAAAAGAAGAATCTTTCATCCGGTCTAAAACCTACCTGGGTCTTGACGCGGGTGAACGT |
| | TCTGGTGTTGGTTTCGCGATCGTTACCGTTGACGGTGACGGTTACGAAGTTCAGCGTCTGGGTGTTCACG |
| | AAGACACCCAGCTGATGGCGCTGAGCAGGTTGCCTCTAAATCTGAAGAACCGGTTTCCAGCCGC |
| | TGCGTAAAGGTACCTTCCCGTCAGCAGGACGTATCCGTAAATCTGCGGTGCTACTGGAACTTCTA |
| | CCACCGCGCTGATGATCAAATACCGTGGCGAAAGTTGTTCACGAAGAATCTGTTGGTTCTTCTGGTCTGTT |
| | GGTCAGTGCGTGCGTGCGTTCCAGGAACCTGAAAAAGCGACGTTCTGCCGAAAAAGTGTAA |
| | AAACGTGTTGACAAAAAAAACGTGAATCTTCTGCCAGGACACCCTGTGGGTGGTGCGTTCTAA |
| | AAAAGAAGAACAGCAGATGCGTTCGAAGTTCAGCGGCGCGGGTTTCTTCAGTTCTGCCTGAAATGCGG |
| | TTGGTGTTCCAGCTGGGTATGCGTGGAAGTTAACCGTGTTCAGGAATCTGGTTCTGTTCTGGACTGGAAC |
| | CGTTCTATCGTTACCTTCCGTGATCGAATCTTCCGATGCAAGTTTACCGTTTCTCCGCAGCAGCTGA |
| | AAAAGTTTCCGTCCGGACATCGAAACCTTCAAAAAATGTTCGTGACTTCATGCGTCCGCCGATGTTC |
| | GACCGTAAAGGTCGTCCGGCGGCCGTCAGAAAACGTTCGCCGTGTCGCTCACCGTCGTTCACCGT |
| | TCGACAAAGTTTTCGAAGAACGTTTCGGTCTGTTCTGCGGTTGTTCGCCCGGTACATCGTTGGTTGCGGTAA |
| | CTTCGACCACTCTTCTGAACAGCTTCAGCCGGTTTCGGGCCGAATGGCGGTTACATCGGACGACAAAGAAGGT |
| | ATGTCTGGTAAAAACTGGTTTACCTTCGTCTGGCCGAACTGATGGCGGAATGGAAACTGAAAAAACTG |
| | GAACGTTCTCGTGTTGAAGAACAGTCTTCTGCCAGTAA |
| SEQ ID NO: 58 | ATGGCGGAATCTAAACAGATGCGTGCGTAAATGCGGTGCGTAACCGTCTATGAAATACGAAGTTATCGTCTG |
| | GGTAAAAAATCTTGCCGTCGTTACATGTGCCCGGACTCTGCCGTCTAAAGCGCAGTCTTGCGCGTATCCGGTTGCGGGT |
| | AAAAAAAACGTGACAAAATACGGTTCTGCGTCAACCATCAAAACTCTACAAATACCCGGCGACCTGAACGGTGA |
| | GCGCTGTACCCCGGACAAAAAGTTCAGACCTGTGTGCGGAAAAATCGGTAAACTCTTGGGCGATCTCTTGGAG |
| | AGTTCACGACGACTCTGGTTGCGGAAATACCGGTCGATCGCGTTCAGGAGACAGTCTGAACGTACTGTTGTTGACTTC |
| | TCCGTCTTCGAATACGCGTGCTGCGGGTGCTGTTTCTCGTGGCCGTGCGGTCTTCGCGCTACTGTCTGTTTCGGTCTTCTCGCA |
| | GCTGTCTGGTGAAGAATTCTTCTGCGGTTCTCCGTCCGGGGTCGCGTTCCGTTCTGTTGACGACATCAACCTG |
| | GCCGACGGCGAAAAATTCTGCTCGCTGGGTATCAAGACCGTATGCGTGAATTGTTCAGGCG |
| | GAATCGACGTTGCGCAGACCGCGGGTCAGCCTTCTGGTCTGCGGCGAAACTGAAAATCTTCGGTATCTTCAGATG |
| | CCGAAGCGAAACAGTGCGACCAGTCGAACAACCGTGTTGGGTCTTCGCTCTGCGTTTCATCGCCGCTCGCTACGGTTCCG |
| | GAAGAAGAACGAAGCGGGTTTCGAACACTGGGTATCGACCCAGTGCGCTGTCTAACTTCTCAACGGT |
| | ATCCCGAAACGTGGTTTCTGGGTCTCCTGAACATCCGCTGGCGTGGCCTGGAACAACATGTCT |
| | GCGATGACCCGTACTGGAAGGTCGTAAAGGTCAAGAACCGACTCGTTGCGGTAAACTGATGAACGTCTGGAACGTCGTCCGTATCTTCT |
| | CTCGTATCCGCGGGTCTGTACCTGTCGTTGCTGTTCCTGCTGAAACGTCTGGACGGTTGTAAACTGAAAGACCAGATCTCTGTG |
| | TTCGTACCGACCTGTTCCTGCGACCTGTTCCTGCTGAAACGTCTGCGCCAGTCTTCGACGTCTCGGAACA |
| | CATGCGTGGTGCCTGTACGTCTCGGCTGACCTGGAAGCGCCGGCCGGTTTCGTTCTAATCCTCAGGACCCGGCGCTT |
| | CGTTCTGACTCTCAGGAATGCGGCGTAATGGCGGTGATCAAGAACTGGAATCAAACGG |
| | TCCCGTTCTTCTTCTCAGGACACCGGTAAAAAAAAAAAAACCAGCCGGAAGCGCGGAAGAAGTTAACGGTCAGGA |
| | GAAGAATACACCGAAAAACCGAATCTATCCAGATAAAGGATTCAGCTACCCCGGCGTTCTTCGGTGAAGGTTCTG |
| | AGGTAACGGTGCGTCTAAAACACCAGAAAAGAGCCGCCAGTATTCGACATGTTCTGCAACATGCGTCCGATC |
| | TTCTGAATACCTATCCGTATCCGGAATTCAGCGCGCGTAAAGCGCGCGCGCGTTTAACAAATGCCGTGACTTCTGCAGAACCGTTGC |
| | TTCATGCAGTGGAATTCAGCCGGTGATCCGCGTAAAGCGCCGGTTTAACAAATGCGCGTGCTGCTGGAATCTGTTCT |
| | AGAAACTGTACAACAGACCTTCTCGAACGTCAGTCTGAAAACGTCTGAAGTGAAGAAAAATTCCGTGCGTCTGCGAAGCGTC |
| | GATCTTCTGGGGTGAATTCTACACCTACGGTGCGAACGAAAAAAAATCGCGGAAATGCGAATCGCGTCGTCCTGTTC |
| | TGAACGTTCTTCTGACCCGGACTACGTTGTTCAGCAGGCGGAACGCCGGGTTGCTGCACGAAGCGTC |
| | GGTTTCGAATGGCGTGACTGCTCGCGGGTGACTCTCTGCGGGAACCTGTTGACCTGTTGAAATCCACAAAAAAGCGATC |

TABLE 6-continued

SEQUENCE LISTING

| SEQ ID NO: | Sequence |
|---|---|
| | TCTTTCCTGCTGGGATCACCCAGGCGCGGAAGTTTCTGTTGGTTCTTACAACTGGCTGGGTAACTCTACCG |
| | TTTCTCGTTACCTGTCTGTTGCGGGTACCGACACCGGTTCTGTTACGCCCTGTCTCTTCAGGAACTGAAAGCGTTCCTGAACGC |
| | GACCCTTCTCTCAGATGCGTGGTTCTGGCAGATCCGTCTGAACCTGAAAGACGGTTTCGAC |
| | GTTCAGCTGGAATCTTCTTGCCAGGACAACCTGAGCACCGACCGCTCGTGCCTCGTTGCTGGACCTGG |
| | CGGCCTGCAAACGTGCGACCTGCCCGGCCGAACTGACCCGGCCGGTGCCGGTGTACCCTGGCGTCACC |
| | TCATCGCGTCGTCTTTATGAAAATGATCGAACGTGTCGTTCTTGTCTGACGCGGAAGTTGGTATGGACCAGAGTACCG |
| | GTCCGCACTCTTTCGTTGCCAGATCCGTTCGTGTCTACCGTTCAAATCAAACCGTTCTCTGCCAGTACGGTCC |
| | GCTGGCGTTCCAGGAACCGACCGAATCTGAACCGTTCAAAATCAAACCGTTCTCTGCCAGTACGGTCC |
| | GGTTCTGTGCTGAACTCTTCTTCTTACTCCAGTACTGACGGTTTCCGTCTCAGCCGAAAA |
| | ACTGGTCTATGCGTGTTCTCGCCAGCGGGTTCGTGTTCGGTTGAACAGCGTTGCCTGATCTGAA |
| | CCTGCAGGCGGTAAAATGCGTCTGGAACGTTCTGGTGCGCGTTCTTCATGCCGGTTCCGTTCT |
| | TTCCCGTCCGTCTGGTTCTGGTGACCGAAGCGGTTCTGGCCGGCAAGCGTTACCTGGGTCTCTTCCCGCACT |
| | CTGGTGGTATCGAATACGGGGTTGACGTTTCTGACTCTGCCGGTTCTCAAAATCCTGAACGTGGTAC |
| | CATCCGCGGTTAACGTTTCTCTCAGAACTGGTGAACGTCAGGAAGAAGCGCACCGTGAAAACAGCG |
| | TCGTGGTATCTCTGACATCGCGTGTAAAAAACCGGTTCAGGCCGGAAGTTGACGCGGCAACGAACTGCA |
| | CCGTAAATACACCGACGTTGCGACCGTCTCGGGTTGCCCGTATCGTTGTTCAGTGGGCGCCAGCCGAA |
| | ACCGGTACCGCGCCGACCACGCGCGACAGACCGTTTACGGCGTCTGGGGTTACACCTGGGAAAAACG |
| | TAAACCGGAAGACATTCCTGGTATCTCTGGTTTACGACCGGTGTATCGTGAATCTTGCCCG |
| | GCGGTTGCCGTTGCCGTCGTCACATCCGTGCGACCTCTACCCAGACCGAATGGGAAAAGAAGAA |
| | GTTGTTTCGTCGTCTGAAAAATTCTTCCCGTCTTAA |
| SEQ ID NO: 59 | ATGGAAAAACGTATCAACAAAATCCGTAAAAACTGTCGCGACAACCGGACCGGTTCTCGT |
| | TCTGTTCCGATGAAACCTCTGGTTCGTTCGTTATGACCGACGACCTGAAAAACGTCTGAAAACGT |
| | CGTAAAAAACCGGAAGTTATGCCGCCAGGTTATCTCTAACAACGGGCGAACACCTGCCTATGCTGCTG |
| | GACGACTACACCAAATGAAAGAAGCGATCTGCAGGTTTACTGCCAGGAATTCAAAGACGAACCGACGTT |
| | GGTCTGATGTGCAAATTCGCAGCCGCGGTCTAAAATCGGCTGTCTCAGTGCGTCTCAGCCGCTGTCGTTTA |
| | GGACGAAAAAGGTAACCTGCACCGCAGCGGTAAAGCGTACCACCAACCGGAAAAGACTCTGACGAAGCGGTTACCTACTC |
| | CAAACTGGAACAGGTTTCTGAAAAGGTAAACCGGAAAAAGACTCTGACGAAGCGGTTACCTACTC |
| | ACACGAAAATGATCCGTCTGGGCCGTGCCGTCCGTGGACTTCCTATCCACGGTTACCAAAGAATCTACCCACCCG |
| | GTTAAACCGCGACCGAGATCGCGGGTAACCGTTACGCCCGTCGGTTGGTGTAAAGCGCTGTCGAC |
| | GCGTCCATGGGGTACCCAGAAACGTCTGGAATCTCGGTGAATCTCTCGTGAACTGGCGGTAACTGGTTGACCGGTGACATCATCGAACACCAGAAGTTG |
| | TTAAAGGTAACCAGAAACGTCTGGAATCTCGGGTGAACTGGCGTGGACCGTAAAGAAAAACCTGAATACCCGT |
| | CTGTTACCCTGCCGCCAGCCGCACCAGTCCCGCAGCCAGCGCACCACCGAGCGTTGACCGTACAACGAAGTTATCGCCGTG |
| | TTCGTATGTGGGTTAACCTGAACCTGTGAACCTGTCTCGGACGCGCGAAACCGCTGC |
| | TGCGTCTGAAAGGTTCTCTGACATTCTGAACCTGTTGTTGAACCGTGTTGAACCGTGACTGGTGAACAC |
| | CATCAACGAAGTTAAAAAACTGACGATCGACGCGAAGTGACATGGGTCTGTTTTCTGTTCGGTTGTTAC |
| | CGCGGAAAGTTCTGCCGAGAAACCTAACACCGGAAACGGTCAGTTCGGTGAACCTGCTGTACTGG |
| | GTGAAGGTTCTGGAAACCGGAAAAACCTGGTAAAGTTAAAAGCGTTAAGCGGTT |
| | AAAAAAAATACGGTAACCCATCCAAATCGAAAGCGCGAAGTTGCGACCTGAAAGAATGACGAAAAGAA |
| | CTGACGACTGGCTCGTGGCGCAAATGTACAGATGTACCCGTTCCGTTCGTTTCGTTCGCGTTGAA |
| | TTCTACGCGTGCGAAATCAGCTGCAGAAATGTACGGTACGCCTGCTCGTAACCGTTCGCGTTGAA |
| | GCGGAAAACCGGTCGTGTGCTGAAATACCCAGTGGTTCTGCATCTCGAAAACGTAAAGCGCAAGCGGTT |
| | ACCTGCTGGCCTGCGCTGTTGACATCTCGAAACGTAAACTGTTCTTCATCGGTTCTGACGCGTATCCAGTACCGGTAAAA |
| | AAGGTCGTATCCGTTCACCCAGACCACCTTCACCGACGATCCTGAAAACGGTAATGCAGCGCGTGACCAGCGTCTGCTGTACG |
| | GTGGTGGTAAAGCGAAGTTATCGCCGTCAGGGTTCATCGACCGAACGAACAGCAGCTGATCATCCTGCCGC |
| | TGGCCTTCGTACCCGTCAGGGTCTGAATTCATCTGACCGCGAACCGGTTCGAAAACCGGTCTGAT |

TABLE 6-continued

SEQUENCE LISTING

| SEQ ID NO: | Sequence |
|---|---|
| | CAAACTGGGAACGGTCGTGTTATCGAAAAAACCATCTACAACAAAAAAATCGGTCGTGACGAACCGG |
| | CGCTGTTCGTTGCCGTGCTGACCTTCGAAGTCGTGAAGTTGTTGACCCGCTGAACATCAAACCGGTTAACCT |
| | GATCCGGTGTTGACCCGTGGTGAAAACATCCCGGCGTTATCGCGCCACCACCCGGAAGGTTGCCGCT |
| | GCCGGAATTCAAAGACTCTTCTGGTGGTCCGACCGACATCCTGCGTACTCCGTGAAGGTTACAAAGAAAA |
| | ACAGCGTGCCGATCCAGGCGGCGAAAGAAGTTGAACAGCGTCGTGCGGGTGGTTACTCTCGTAAATTCGC |
| | GTCTAAATCTCGTAACCTGGCCGACGACATGGTTCTAACCTGTCTCGTGGTCGTGACCTGTTCTTACCACGCGTT |
| | ACCCACGCGGTTCTGGTTTCCAAAATGGAAGACTGGCTGCACCCGGTACCCGAAACTGGCGTACGAAGGTCTGACCT |
| | TGACCGAACGTCAGTACGACTGTGTTCAAAACCTGGCGCAGTACAACCTGCTCTAACTGCCGTTCCATT |
| | CACCACCGCGACTACGACGGTATCGTGTTCTGTCGAAGAATCGGTACCACCCTGACCGGTTGGGCGACCGTTG |
| | GAACAACAAAGAACGTCAGAAAGCGAAGGTCAGATCAACACCTACTACAACGTCAGAACCGTTG |
| | AAAAAGAACTGTCTCGCGAACTGGACGCGTGTTCTGCTGAAGTTCACCCGGAAATCGTAACAACGACATCTCTAAATGA |
| | CCAAAGGTCGTCGTGACCTGACCTGCAGAAGCGCGTGTTCCTCGTCTGAAAGAAACGTTTCTCACCGTCCGGTTCAGGAAC |
| | AGTTCGTTTGCCTGACCGAACTGCTGCGGTCACGAAGTTCACCGGACGAGCCGGCGTGAACATCGCGCGTT |
| | CTTGGCGTCGTTCCTGAACTCTAACTCTAACCGAAGTTCAAATCTTACAAATCTGGTAAACAGCCGTTCGTTGG |
| | TGCGTGGCAGGCGTTCTACAAACGTCGTCTGAAAGAAGTTTGAAACCGAACGCG |
| SEQ ID NO: 60 | ATGAAACGTATCAACAACGAAATCCGTCGTCGTCTGGTTAAGACTCTTAACACCTTAAACACCAAAAAGCGGGTAAACC |
| | GGTCCGATGAGAAAACCCTGCGTTCGTGTTATGACCCCGGACGTCTGGTGAAGTCTGAAAACTGCGT |
| | AAAAAACCGAAATGAAAAGCCGATCCTGCAGCCGATCCTGCACGTTACTGGGAAGAATTCCAGAAAGACCCGTTGGT |
| | GACTACACCGAAATGAAAATGAAAAGCCGATCCTGCACGTTACTGGGAAGAATTCCAGAAAGACCCGTTGGT |
| | CTGATGTCTCGTGTTGCCGCAGCCGGCGAAAACATGACCAGCGTAAACTGATCCGTAAAGAC |
| | GGTAACGAACGTCTGACCTTCGACCTCGTGTTCGTCGTCAGTGCCGTCCAGCCGTAAACTGATCCGTAAGTTTACAAAC |
| | TGGAACAGGTTAACGACAAAGGTAAACCGCACACAACCGGATACTCTCGGTCGTGCAACGTTCTGACACG |
| | AACGTCTGATCCTGCTGTCTCCGACAAACCGGATACTCAACCGGATCTAACAACCAACCGGTTAAAACC |
| | AATTCGGTCAGCGTGCGTCGACTTCTAATCGAGCGGTACCCGTGAATCTAACCACCCGGTTAAACC |
| | GCTGGAACAGATCGGTGTAACTCTTGGTCGTTGCCCGGCGAAACATCCTGCCGAATCGAAGCGCTTGCGCCGTCAT |
| | GGGTGCGGTTGCGTTTTCTGACCTCTTTTCCCGTCGTTGAACGTCAGGCGAACGAAGGTTGACTGGTGGACATGGTTTGC |
| | AAACGAAAAACGTCTGGCGACCGCCAGCCGCACCACAAAGAAGTATCGAAGCTACAACAACGCTTGTTGCAGATCGTTAT |
| | CCTGCCGCGCCAGCCGCACACCAAAGAAGGTATCGAAAAATCGAAATCGAAAAATCGCGTCCGGACGAAGCGAAACCGCTGCAGCCGCAT |
| | CTGGGTTAACCTGAACCTGCCGTCCCGTCGTTGAACCGTGGTTGAACGTGAACGAAGTTGACTGGGACATGGTTTGC |
| | GAAAGGTTTCCCGTCTTCCCGTCTGGTTGAACGTGAAGGTCTGTCTAACACAATCGAAGAAG |
| | AACGTTAAAAATCAACGAAAAAAAAGAAGACGGTAAGTTTTCGCAGAACCTGGCGGGTTA |
| | CAAACGTCAGGAAGCGCTGCTGCGCCAAAAGAAGGTAAGGTAAAAGGTAAAAATTCGC |
| | GCGTTACCAGTTCGGTGAACCTCGGGGTCAGAACGTGAAGACCTCGACAATATCTCGCAGCGTCT |
| | CGACAAGCGTGGGAACGTATCGACAAGAACGTGAAGGTCTGTCTAAACAACATCAAACTGGAAGAAG |
| | AACGTCGTTCTGAAGACGTAAGCGCCCAGTCTAAAGCGCCGACTGGCTCCGTGCGAAAGCGTCTTTCG |
| | TTATCGAAGGTCTGAAAGGTCAGCAAAGGCGGACAAAGGACGAATTCTGCCGTTGCGAACTGCAGAAATGGT |
| | ACGGTGACCTTGCGTGGTGTAAAACGTTGCGACTCAACGGTGCGTGTTAAAAACCGTCTACCTGATCAT |
| | TAAACATCAACTGCCGTGCCGCCGTTCATCTGCAGAAGACGTGTTTAAAAAATCAAACAAACGTCTGACACAC |
| | CAACTACTTCAAAGGTGGTAAACTGCGTGTTTCAAAAAATCGTGAAATCGTTCCGATGAAGTTCCGATGAAAGCGTTT |
| | CTAACCGGTTATCAACAAAAATCTGGCGACCGTTCGTAACGTTCAGGGTCTGAATTCATCTGGAACGACCTGG |
| | TCTCTGGAAACCGGTTCTGCTGAAACTGGCGACTCGTGTTTATCGTGACCTTCGAACGTCTGAACCGTCGT |
| | ACCCCTCAGGACGAACCGGCGGTCGTATGCTGTCTTGTTGCGCTGTCACCGTATCCGCGGTTATCGCGGTGACCCG |
| | ACATCAAACCCGATGAACCTGAACCTGATCCGTCTCGTTTCAAAGACTCTCTGGTTAACCGACCCACATCTGCGCTGACCG |
| | ACCCGAAGGTTGCCCGCGTTCATCGACCTACCATGCAGCGAAATACCGGCTACAAACCTGGCTGCGAAGAAGTTGAACAGCGTCGTGCGGGTG |
| | TGAATCTTACAAAGAAAACAGCGTCGTCTAAAGCGAAACCGCTCTAAAGCCGCTGCGAAAATCCTGCGGTATCGG |
| | GTTACTCTCGTAAATACGCGTCTAAAGCGTCAAACCGGACGACATGTTCTAACACCGCGCGTG |

TABLE 6-continued

SEQUENCE LISTING

| SEQ ID NO: | Sequence |
|---|---|
| | ACCTGCTGCTGTACTAGCGGGTTACCCAGGACGCGATGCGATGATCTTCGAAAACCTGTCTCGTTGGTTTCGGTCG |
| | TCAGGGTAAACGTACCTTCATGGGCGGAAGCTCAGATACGACCCGTATGGAAGACTGGCTGACCGCCGAAACT |
| | GGGCTACGAAGGTCTGCCGTCTAAAACCTACCTGTCTGGGACTACGACCGTGTTCTGGAAAACCTGGGGCAGTACACCTCTAAAACCGC |
| | CTCTAACTGCGGTTTCACCATCACCTCTGCGGACTACGACCGTGTTCTGGAAAACTGAAAAAACCGC |
| | GACCCGTTGATGACCACCATCAACGGTAAAGACCTGAAAGTTGAAGGTCAGATCACCTACTACAACCG |
| | TTACAAACGTCAGAACGTTCTTCTGACCAAAGTCGTTCTGTGTTGAACTGGACCGTCTGTCTGAAGAATCTGTTAAC |
| | AACGACATCTCTTCTTGACCAAAGTCGTTCTGTGCTGAACTGCGTGTTTCGAAACCGCGACCAACAGGCG |
| | ACCGTCCGGTTCAGGAAAAATTCGTTTGGTCGTTCCTGAACTGCGGTTTCGAAACCGCGACCAACAGGCG |
| | CGCTGAACATCGCGCGTTCTGGTGTTCCTGCGTTCTCAGGAATACAAAAATACCAGACCACAAA |
| | CCACCGGTACACCCGACAAACGTGCGTTCGTTGAAACCTGGCAGTCTTTTCTACCGTAAAAAACTGAAAG |
| | AAGTTTGGAAACCG |
| SEQ ID NO: 61 | AAAATTCatGCAAAATGTCCGGTTTCATGTCATCAAAATGATGACGTAATTAAGCATTGATATTGAGA |
| | TCCCTCCCTGACAGGATGATTACATAAATAGTGACAAAAATAATTAATTTATTCCAGAAAT |
| | GAATTGGAAAAATCAGGAGAGCGTTTTCAAATCCTACCTTCGGCGCAGTTGTATATGTcaaaCAGGTgcgtcactgc |
| | gtcattactggctcactcgtcgtaacccggtaacccgcttattaaagcattctgtaacaaagcgggaccaaagccatgacaaaaacgcgtaacaaagtgtctataat |
| | cacggcagaaagtccacattgattatagcacggcgtcacactagctagctatgccataagcattatccataagattagcggatcctacctgacgcatttatcgcaactcctactg |
| | tactccataccccgttataggccagccgcctatctcgtgagataggcggagataccggaactaagaaagcAAGGAGatataccATGGGTAAAATGTATT |
| | ACCTTGGTTTAGACATTGGCACGAATTCCGTGGGTACGGGGTGACGGACCCTCATACCACCGCTGCTGAA |
| | GTTTAAGGGGAACCAATGTGGGGTTGCGCACGTATTTGCCCCGGTAATCAGAGCGCGGAACGACGCTC |
| | GTTCCGCACATCGCCTCGTCGTTTGGACCGACGCCACCAGCGCGTTAAACTGGTACAGGAGATTTTTGCC |
| | CCGGTGATTAGTCGATCGACCCACGCTTCTTCATTCGTCTGCATGATCCGCCTGTGGCCGATGACG |
| | TCGCGGAGACGGATAAACATATCTTTTCAATGATCCTACCTACTATCGATAAGGAATATATTATAGCGGATTA |
| | CCCGACTATCCATCACCTGATCGTTGATCGGACACCACCTGCATTTTCTGAACGAGGTGGACAAGGATAATATTGG |
| | CCTTGCAGTGGCGTGGTTAGTGACGGCCATTTATCCGGAGTTTCTCGCGTTCCTGCTGGGCGGTGTATCACCG |
| | AGATGTGTTGTTGCCGAAAGCAAAGCGTCTGCAGGCGACCTGCTGAGCCGTAACTCAGTGACGACAATATAA |
| | AGCCCTTAAGTCTCGATCTTCGGATCCCAAGAAACCGAAAGGTAAAGTTAACAAACTGTTCCTCAGGAATCGAACGAT |
| | GGACTCATTCAACTGCTGCCCGCAAAAAGAAGACGCGATAGAAGAGGTAAAAACATTGAATGCTCAGGTCCTTACACCAGATGAA |
| | GCATCCTTCACATTGAATGATAAAGAAGACGCCGATTTGACTGGGCTATCATGAAACATGCTCTGAAAGATGGCA |
| | TGTGAATGGATTGCCGCATATACGGCCGCCTTTTTGACTGGGCTATCATGAAACATGCTCTGAAAGATGGCA |
| | GGACTATTAGCGAGTCAAAAGTCAAACTGTATGACGAGCATCACGATCTGACCCAACTTAAATACT |
| | TCGTGAAAACCTACCTTGCAAAGAATACCACGATATTTTCCGCAACGTGGATAGCGAAACAACGAAAA |
| | ACTATGTAGCGTATTCCTATCATGTGAAAGAGGTGAAAGGCACTCTGCCTAAAAATAAGGCAACGCAAG |
| | AAGAGTTTGTAAGTATGTCCTGGGCAAGTTAAAAACATTGAATGCTCTGAAGCAGACAAGGTTGACT |
| | TTGAGAGATTCAGCGTCTTACCGACACTCTTTTATGCCTAAGCAGGTTTCGGGCGAAAACGCGT |
| | TATTCCTTATCAGTTTATATTATTAATGAACTGAAGACAATTCTGAATAAAGCAGCCTGCTGCCTTCC |
| | TGACGCAGTGTGGAAAAGATGCAATTTCGAACCAGGACAAACTACTGTCGATCATGACGTTCCGTATTC |
| | CTTACTTCGTCGGACCGTTAACGACAAAGTGGACTTGGATAAATCGAAGAAGCGTTCATTCGCCGAATGA |
| | TTTATCCGTGGAACTTTAACGACAAAGTGGACTTGGATAAATCGAAGAAGCGTTCATTCGCCGAATGA |
| | CCAATACCGTACCTATTATCCGGCGAAGATGTTTTACCGTGAAGATATTCAGAACGTCTGATCTATGAGAATTTAT |
| | GATTTTAAATGAAATCAATAATTCGTATTGACGGCTACCCGATTAGTGTTGACGTTAAACAGCAGGTT |
| | TTTGGCTTGTTGAAAAAAACGACGTAACCGTAAAGATATTCAGAACGTCTGAAATGTCTTAACGTATCAC |
| | GCTCTGGACAACGCGGGAAGCTGACAGGCGTAGATGCCTATCCACTCAACTATAATACGTATCAC |
| | GATGTGAAACACACATTTCGCTCATGATGGACGCTCCCTCAGCCGTTGGCCGTTTATCCAAAATGTCTTAACGGTC |
| | ACCTACAGCGACGATACTAAGCGTGTGCCGTTCTGCAAACACCGATTTGGCCGTTTATCCAAAATGTCTTAACGGTC |
| | TGAAGGGTGTCCATAAGGAGACCCGTGAACGCTCCCATACTGACTTCATGTGGAACACGAACGATA |
| | ACCTGATGCAGCTCCTTTCGAATCGTACAGCTCTACAGTCTCAGTGATGATGAAATCACAAAGCTGCAAGAGGCGTATT |

TABLE 6-continued

SEQUENCE LISTING

| SEQ ID NO: | Sequence |
|---|---|
| | ATGCAAAAGCCCAGTTGTCTTTAAACGATTTTTAGACTCGATGATACATCTCTAACGCGTGAAACGTCC<br>GATTTACAGAACTCTGGCAGTGTGATGGTGAATCAGTATTCGAAAAGCATGTGGACGGCCCCTAAACGCATTT<br>CATCGAAATGCTCCGTGATGTGATGTCTAAAGATTTCAAAAAAAAAGAGAGTGTTACACGTCGAAGCAGATCAAAA<br>ACCTGTACCGCTCGATTCGTAAAGATTCCAGCAGGAGTTGATTTTCTGGAAAAGATCCTGGAAAATA<br>AATCTGATGGTCAACTTCAGTCAGATGCTTTGTATCTTACTTTGCAATTAGGGCGCGATATGTACAC<br>GGGCATCCAATAAGACTGGAGCACATCAAAGATCAGAGTTTCTATAACAGACAATTAACGCGAGAAA<br>GTCTATGGTGAAAGACGAATTCCCTAGATACAAGTCAAAGCGAAATTAACGCGAGAAAA<br>GCTCCGATACCCTTTGGACGCCGATCCGCAATAAAATGAAGCCCCTTTGGACGCTTACTATAATCA<br>TGGCCTGATCTCCTTAAAGAATACCAGCGTCAATCTAACGCGCTCTACCAAAGCGCTGGCCATTTTGTTGAAGCGT<br>GGACTTTATTAATGCCAGTTAGTGGAAACCCGTCAATCTAACGCGCTCTACCAAAGCGCTGGCCATTTTGTTGAAGCGT<br>AAGTTTCCAGACACCGAAATTGTATTCGAAGCGGGGTTATCGTCGACTTCGAACATGAATTCGGC<br>CTTGTAAAAAGTCGCAATATTAATGATTTGCACCACGCTAAAGACGCATTCTTGCCTATCGTTACCGGCA<br>ATGTTACCCATGAAAGATTCAATGCAGATGGTTTATGGTGAACCAGCCGACTCAGTTAAACTAAAA<br>CTCTTTTTACCCACAGCATAAAGAATGGCAACTTCGTTGCCTGGAACGGCAAGATCTCGGTCGTAT<br>TGTAAAAATGCTGAAGCAAAACAATTCACTTCACCGCGCTTCTCCTTCGACTCGCAAAGAAGG<br>ATTATTTGATATCCAACCTGAAAGCCAGCACCCGCTTAGTCCAGCCGGTCGATGATCGTCGTT<br>AAATACGGCGGATATGACAAATCTACCGGCGGCCTGTAGAAGGCCTGTACAAGGCTGAGGACAAG<br>GAATTTCTTACCGATTATGCCGAATATGCGATTATCTCAGAGAAGATAAACGAAAGTGATC<br>AATATTATGTTCCAATGGGTACGAGGCATATAAAACTCAATCTATGTCACGCAATGTTCCACTGATCGTCCC<br>TTAGTATCGGCGGAAAGTCCTCTAAAGGTAAGTCAGTTCAGTGAAAGCTTCGCCGAAGTTAAAGAAAACAACAAGCT<br>TCACAAATCGAATGTTACATTAACGAATGGAAAGCAACCTGATAAAATCTACGAGCTCTTTCTCCA<br>GCGCATCGTAGAAAAATTCGATAATCCTATAATAAGTTTTTCGACACAGTTTGACTACTGACGACGGCGTTCT<br>AAAACTGCAGCATATCCCTATAATAAGTTTTTCGACACAGTTTGACTACTGACGACGGCGTTCT<br>ACTTTCACAAAACTGCCGGAGGAACAGGTACGACAGGTTTAAGTATCTTTAAAACAT<br>GCCGCAGTTCGGGTTGCGACTGTGCAAAATCATCACGCAGTGCCCAGGCAGCGCGATCATGATTAGCG<br>CTGACTTAACTGGACTGTCGAAAAATATTTCTCTAAGAATCATCTAGCGAAGTCAGCTTCTGTTTGTT<br>CGTATCCAAAAGTCAGAACTTACTGGAGTATCTCATAATAAGTATGTAGGATCAAGCTCAGGTTAAATATTCACT<br>TTATCTGAAATTTATTATATCGCGTTGATTATTGATGCTGTTTTTAGTTTTAACGGCAATTAATATATGTG<br>TTATTAATTGAATGAATTTTATCATTCATAATAAGTATGTAGGATCAAGCTCAGGTTAAATATTCACT<br>CAGGAAGTTATTACTTCAGGAAGCAAAGACGATTACAGAATTATCTCATAACAAGTGTTAAGGATGTTA<br>TTTCC |
| SEQ ID NO: 62 | AAAATTCcatGCAAAAATGCTCCGGTTTCATGTCATCAAAATGATGACGTAATTAAGCATTGATAATTGAGA<br>TCCCTCCCCTGACAGGATGATTACATAAATAGTGACAAAAATAATTATTTATTCCAGAAAT<br>GAATTGGAAAATCAGGAGAGCGTTTTCAATCTACCTCGGAATCTGATATGTcaaaCAGGTgccgtcactgc<br>gtcattactggctcactcgctaaccaaacggtaacccccgcttattaaagcattctgtaacaaagcgggaccaaagccatgacaaaaacgcgtaacaaagtgtctataat<br>cacggcagaaagtccacattgattatagcccagcacggcgtcaacactgctatgccaagctatgccatagagcgacgcattatcgcaactcctactg<br>tactccataccgttatagggctagcaccgcatctagcaggcaggcgagataaGcgccaaaacactgg<br>AATTCACTTAACAAATACTCTAAACAGCTCACCATTAAGAATGAACTCATCCCAGTTGGCAAAACACTGG<br>AGAACATCAAAGAGAATGGTCTGATAGATGGCAGAACAGCTGAATGAGAATTATCAGAAGGCGAAA<br>ATTATTGTGATGATTTTCTGCGGACTTCATTAATAAAGCACTGAATAATATACCAGATCGGGAACTGGC<br>GGAACTGGCGGATGCCCTTAATAAAGAGGATGAAGATAACATCGAAGAATTGCATGGACTATAAATTCGG<br>TTATTGACGACGACAATGATGTTGAAGAAGGAACTGGATCTGGCAAGAAGACCAGCTCATTTAAAT<br>ACATATTTAAAAAACCTGTTTAAGTTAGTGTTGCCATCCTACCTGGCAAGAAACCACAAACCAGGACAAGC<br>TTGAAGATTATTAGCTCGTTTGATAATTTTCAACGTACTTCCGCGGTTTCTTGAAAACGGAAAAACAT<br>TTTTACCAAGAACCGATCTCACCAAGTATTGCCATTGTTCATGATAACTTCCCCGAAATTCCTT<br>GATAACATTCGTTGTTTAATGTGGCAGACGGAATGCCCAACTAATCTGAAGCAGATACTAT |

TABLE 6-continued

SEQUENCE LISTING

| SEQ ID NO: | Sequence |
|---|---|

TABLE 6-continued

SEQUENCE LISTING

| SEQ ID NO: | Sequence |
|---|---|
| | ATATGTGTTATTAATTGAATGAATTTTATCATTCATAATAAGTAGTATGTGTAGGATCAAGCTCAGGTTAAAT<br>ATTCACTCAGGAAGTTATTACTCAGGAAGCAAAGAGGATTACAGAATTATCTCATAACAAGTGTTAAGG<br>GATGTTATTTCC |
| SEQ ID NO: 63 | AATCAGGAGAGCGTTTTCAATCTCTACCTCTGGCCGCAGTTGATATGTCAAACAGGTTGCCGTCACTGCGTC<br>TTTTACTGGCTCTTCTCGCTAACCAAACCGGTAACCACCCCGCTTATTAAAAGCATTCTGTAACAAAGCGGGA<br>CCAAAGCCATGACAAAAACGCGTAACAAAGTGTCTATATCACGGCAGAAAAGTCCACATTGATTATT<br>TGCACGGCGTCACACTTTGCTATGCCATAGCATTTTATCCATAAGATTAGCGGATCCTACCTGACGCTT<br>TTTATCGCAACTCTCTACTGTTTCTCCATACCCGTTTTTGGGCTAGCAGTAATACGACTCACTATAGGG<br>GTCTCATCTCGTGTGAGATAGGCGGAGATACGAACTTTAAGAGGAGGATATACCATGCACCATCATCAT<br>CACCATAACATACGACGAATTCACCAAACTGTACCCGATCCAGAAAACATCCGTTTCGAACTGAAA<br>CCGCAGGGTCGTACCATGGAACACCTGGAACCTTCAACTTCTTCGAAGAAGACCGTGACCGTGCGGAA<br>AAATACAAAATCTGGACTGGAACTCTGACGACGAATACCACAGAAGCGATGACGAATACTCACAAATACACAAATCGTGAAGAAAAGA<br>CATGTCTCTGGACTGGAACTCTGACGACGAATACGACGAATACTCACAAATTACACAAATCGTGAAGAAAAGA<br>CAAAAAAGTTTTCCTGTCTGAACAGAAACGTATGCGTCAGGAAAGCGGTAAAAATACTACAAAAAGACGA<br>CCGTTTCAAAGACCTTGTTCTCTAAAAACTGTTCTGTCTGAACTGCTGAAAGAAGAATCACAAAAAAGG<br>TAACCACCAGGAAATCGACGCGTGAAATCTTGACGGTGACGGAATCACCGCGATCTCTAACCGTATCGTTAACGAAAC<br>AACCGCTAAAAACATGCTACTTCGACGGTGACGAACCGATCTCTAACCGTATCGTTAACGAAAC<br>TTCCCGAAATTCCTGGACAACCTGCAGAAATACCAGGAAGCGCGTAAAAAAGAATCTTTCTCTTTACATCCCGACGTTT<br>AAGCGGAATCTGCCGTGGTTGCCGCACACATCAAAATGACGAAGTTTCTCTCTGGAATACTTCAAC<br>AAAGTTCTGAACCAGGAAGGTATCCAGCGTTGACAATCGGCCGTCTGGGCTGTTACCGTTACCGCTGGAAATCTGGT<br>GAAAAATGATGGTCTGAACGACGCGCTGGGCGCCACCAGTTCTGAAAAATCTTCTAAAGTCGT<br>ATCCCATGACCCCCGCTGTTCAGAAATACCAGGAAGCGCGTAAAAAGAATCTTTCTCTTACATCCCGACGTTT<br>TCACCGAAGACTCTCAGCTGCTGCCGTCTATCGGTGGTTTCTCCGCAGATCGAAAACGACAAAGACG<br>GTAACATCTTCGACCGTGCGCCTGAAACTGGTAACCATCTGCCATAACTGAACGAGCTATCTACAT<br>CCGTCAGGCGGACATCAACCGTCGTTCTAACGTTATCTCGGCAGAAGCGCATCGCTGGGTTGGTCAAATGG<br>CGTGAATACAAAGCGGGACTTCTATCGACGACATCAACGTACCTGGAACGTGACCTGCAAAACGACCGGTAACAACGACGCG<br>CTGGACTCTAAAGATACAATCTCTAAAATGCGTACCGCGCGTGAAAAAATCGACGCGCGTAAAGAAATGAA<br>TTCAACGAATAACATCTCTAAAATGCGTACCGCGCGTGAAAAAATCGACGCGCGTAAAGAAATGAA<br>ATTCATCTCTGAAAAATCTCGGTGACGAAGAATCTATCCACATCAACCCTGCTGGACTCTGTT<br>CAGCAGTTCCTGCCAGCTTCTTCAACCTGTTCAACGAATGGTTCAGGACATCCCGCTGGACGGTGCGTTCTACG<br>CGGAATTCGACGAAGTTCACTCTAACCTGTCCGCATCGTCCGTGTACAAACAAAGTTCGTAACTACCT<br>GACCAAAAACAACCTGAACACCAAAAATCAACACTGAACTTCAAAACGAACCTTCAAAACCCGAACGGTT<br>GGGACCAGAACAAAGTTTACGACTACGCGCTCTCTGATCTTCCTGCGTGACGGTAACTACTACCTGGGTAT<br>CATCACCGAAACGTAAAAAAACATCAAATTCGAACGACGGGTTCTGGTAACGTCCGTTCTACCGTAA<br>AATGGTTTTACAACAGATCCCGGGTCCGAACAAAACATCCGAAGGTTACGACGGACCAAACCATCCGTGGTG<br>TAAAAAAGAATACAAACCGTCTCGCCACAACCGTCTCGCCAAATGCTGAAAACACAAAG<br>ACAAATTCGACCTGACTTCAACTTCCACTTCTCCGACCGAATCGATCGACTTCTTCAAGAATCTATCGAAAAACACAAAG<br>ACTGGTCTAAATTCAACTTCAACTTCTCCGACCGAATCGATCGACTTCTCTAAGGTGACATCTCGAATTCTACCTGGAC<br>GTTGAAAACAGGGTTCACTCTATGCACTTCAGAAAACATCTCGGAAACCATCGACGAATACGTTGAA<br>AAAGGTGACCTGTTCTCCAGATCTACAACAAAGACTTCGTTAAAGCGGCCGACGGTAAAAAGAC<br>ATGCACCATCTACTGGAACGCGGCGTTCTCTCCGAAACATCTGCAGAAAACTGTGTTTAAACTGAAC<br>GGTGAAGCGGAACTGTTCTACCGTGACATCTGACCAAATCTGACATCAAAGAAAATCGTTCACCGTGAAGGTGAAATC<br>CTGGTTAACCTACTACAACGGCGTCGTACCAAAGACCTGGGTGAAGCGAAAGAATACCTGACACAAAGTTGTTACTTCAAGCG<br>CACAACGGTCGTACCAAAGACCGTCGTTACCTGAAGCGAAAGAATACCTGACACAAAGTTGTTACTTCAAGCG<br>CACTACGACATCACCAAAGACCGTCGTTACCTGAAGCGAAAGAATACCTGACACAAAGTTGTTACTTCAAGCG<br>ACTTCAAAGCGACGGTAAAAAACCTGAACAAAATGGTTATCGAAAATTCCTGTCTGACGAAAAA<br>GCGCAACATCATCGACCGTATCGACGTTCTGAACGTTCTGACTACTCTATCATCGACCGTTCTGGTA<br>AAATCATCGACCAGCAGTCTCTGAACGTTATCGACGGTTTCGACTACCGTGAACTGAAACTGAACCAGCGTG |

TABLE 6-continued

SEQUENCE LISTING

| SEQ ID NO: | Sequence |
|---|---|
| | AAATCGAAATGAAAGACGCGTCAGTCTTGGACGCGATCGGTAAATCAAAGACCTGAAAGAAGT |
| | TACCTGTCTAAAGCGGTTCACGAAATCACCAAAATGGCATCCAGTACAACGCATCGTTGTTATGAA |
| | GAACTGAACTACGGTTTCAAACGTCGTTCAAAGTTGAAAACAGATCTACCAGAAATTCGAAAAC |
| | ATGCTGATCGACAAAATGAACTACCTGGTTTTCAAAGACGCGCCGGACGAATCTCCGGGTGGTTCTG |
| | AACGCGTACCAGCTGACCAACCCGCTGACTTCTTCGCGAAATCTGGGTAAACAGACCGGTATCCTGTTC |
| | TACGTTCCGCGCGGCTACACCCTCTAAAATCGAACCCGACCGTTCGTTAACCTGTTCAACACCTCTT |
| | CTAAAACCAACGCGGAGAACGTAAAGAATTCCTGCAGAAATTCGAATCTATCTTACTCTGCGAAAG |
| | ACGGTGGTATCTTCGCGTTCGACCTACCGTAAATTCGTACCTCTAAAACCGACGAACCGTTCGA |
| | TTGGACCGCGTACACCAACGGTGAACGTATGCGTTACATCAAGAAAAAAACGTAACGAACTGTTCGA |
| | CCCGTCTAAAGAAATCAAAGAAGCCTGACCTCTTCTGTATCAAATACGACGTGGTCAGAACATCCT |
| | GCCGGACATCCTGCCTTCTAACAACGTCTGATCTACCACCATGTACTCTTCTTCATCGCGCGATC |
| | CAGATGCGTGTTTACGACGGTAAAGAAGACTACATCATCTCCCATCAAAACTCTAAAGGTGAATTC |
| | TTCCGTACCGACCCGAAACGTCGTGAACTGCCGATCGACGCGGACGCAAACGTGCTACAACATCGCG |
| | CTGCGTGGTGAACTGACCATGCCGTCGATCGCGCGAAAAATTCGACCCGGACTCTGAAAAATGCGAAA |
| | CTGGAACTGAAACGTGGTTGAATTCATGCAGACCCGTGGTGACTAAGAAAATCATCCTTAGC |
| | GAAAGCTAAGGATTTTTTTATCTGAAATGTAGGGAGACACCCCTCAGGTTAAATATTCACTCAGGAAGTTAT |
| | TACTTCAGGAAGCAAAGAGGATTACA |
| SEQ ID NO: 64 | AAAATTCcatGCAAAATGCTCCGGTTTCATGTCATCAAAATGATGACGTAATTAAGCATTGATAATTGAGA |
| | TCCCTCTCCCTGACAGGATGATTACATAAATAATAGTGACAAAAATAATTATTTATCCAGAAAT |
| | GAATTGGAAAATCAGGAGGAGCGTTTTCAATCCTACCTCTGGCACGTTCGATATGTcaaaCAGTtgccgtcactgc |
| | gtcattactggctcactcgctaaccaaaccggtaaccccgcttattaaaagcattctgtaacaaagcgggaccaaaagcgtaacaaaagtgtctataat |
| | cacggcagaaaagtccacattatagcacggcgtcacactgcatagcatgccatagccatagatatatccatatgccatatgccatatgccatatgccatatgccatatgccatatgccatatgccatatg |
| | tactccataccggttataggcgtagcaccgctactctcgtgagtaaggcggagataccgaactaaagatggagAGGAGatataccATGACTAAAACATTTG |
| | ATTCAGAGTTTTTTAATTTGTACTTCGCTGCAAAAACCAGGGCTTTAAAAACAGGGCTGTGTGTGAGCGAAGATGAAAAGCGAGC |
| | CGTCGATTACCAGAAGTTAAGGAAGAATAATTGACGATTACCATCGGATTTCATTGAAGAAGTTAAA |
| | TTATTTCCCGAACACGTTAAGATGTCTCTTGACCAGGCGTTTCATCTTTTATCAGAAACTGAAGGCA |
| | GCAAAAGTTGAGGAGAAGGGAAAAAGCGCTGAATAAAGCCCGCTTCTCAAGGATTGATAAAAGGAACTACGTGAAA |
| | AAGTGGTGAAATGCTTCTCGGACTGTGCTCGCCCAGAATCGCGAAGGATGATATCCTACGGTCGAAACGTTTA |
| | ACAACTTCACCACATATTTACCGGCTTCCATGAGAATCTAAAAAATATTATTACTCCAAAGATGATCACGC |
| | CACCCGTATTAGCTTTCGCCTTATTCATGAAATAAAATTTGAAATCAACGTGATTAGCTTCAATA |
| | AGTTGAAGAGGGTTTCCCTGAATTAAAATTTCGTTAACTTCGTGACCAAGCGGGCATAGATCAGTATAATTA |
| | TGAACATGCGTTTGAAATAGAATATTTCGTTAACTTCGTGACCAAGCGGGCATAGATCAGTATAATTA |
| | TCTGTTAGGAGGGAAAACCTGAGGACGAAAAACAAGGGATGAAATGAGCAAATTAATCTGT |
| | TCAAACAACAGCAAACGGAGATAAAGCGCGTCAGATTCCCAAACTGATCCCCTGTTCAAACAGATTC |
| | TTAGCGAAAGGACTGAAAGCCAGTCGTTTATTCCTAAACAATTTGAAAGTGATCAGGAGTTGTTCGATTC |
| | ACTGCAGAAGTTACATAATAACTGCCAGGATAAATTCACCGTGCTAAACAAGCCATTCTCGGTCTGGC |
| | AGAGGCGGATCTTAAGAAGGTCTTCACAGAATCTCCAGAAAACCTCTATCTATCTAACACCATTTTCGGG |
| | AATTACAGCGTCTTTTCCGATGCACTGAACCTGTATAAAGAAAAAGCCTGAAAACGAAAAGCGAGGAG |
| | GCTTTTGAGAACTACCGGCGCCCATTCTATTCACGACACCCGACTACTTCATCAAGACGATGAATTATATT |
| | CTCGCTTCATTAAATCCACTAGCAGGCTTCCACTGTCCAGCGCCTTTCTTGTTCGAACTGGAAGCCCTGTC |
| | ATCTAGCGCGCGCCACCGAATCGGAAGATGAAAAGACCAGTCCTTTTATGAAGGCAGAAGCTTCAGCAGATCA |
| | AGCTATTAAAGCTTCCTGGATACGCTTATGAAGCGGTACACTTTGCAAAGCCGTTCTATCTTGTTAA |
| | GGTCTAAAATGATCGTTAATCATTCCTATCTATCATAACAACACGCTACTGAGCGGATGGGATCAGATCA |
| | GCCGATAAATTCAAGATTAATTTTTGACAACAACAACGCTACTGAGCGGATGGGATGCGAACAAGGAAACT |

TABLE 6-continued

SEQUENCE LISTING

| SEQ ID NO: | Sequence |
|---|---|
| | GCTAACGCGTCCATTCTGTTAAGAAAGACGGGTTATATTACCTTGGAATTATGCCGAAAGGTAAGACCT<br>TTCTCTTTGACTACTTTGTATCGACGAGGATTCAGAGAAACTGAAACAGCGTCGCCAGAAGACGCCCG<br>AAGAAGCTCTGGCGAGGATGGTGAAAGTTCTTTTTAGCAACAAAAAATTGGCTTTTACAACCCGTCGATGACATTTT<br>CAAAGATGTTACCGAACAGTCTTCTCACCACCAAAACGGGACCCCTCAGAAAGGCCACTCAAAAGTTGAGTT<br>ACGCATTCGCAACACAGCCTCTCACCACCAAAACGGGACCCCTCAGAAAGGCCACTCAAAAGTTGAGTT<br>TAACCTGAATGATTGTCATAAGATGATTGATTTCTTCAAATCATCAATTCAGAAACATCACCCGGAATGGGG<br>GTCTTTTGGCTTTACGTTTCTGATCACTGATTTTGAAGACATGAGTGCCTTCTACCGGAAGTAGAA<br>AACCAGGGTTACGTAATTAGCTTTGACAAAATCAAAGAGACCTATATACAGAGCCAGTGGAACAGGGT<br>AATCTCTACTTATTCCAGATTTATAACAAGGATTTCTGCCCCTACGACAAAGGCAAACAAACCTGCATA<br>CTCTGTACTGGAAAGCCCTGTTGAAGAAGCGAACTGAATAACGTAGTGCGAAGTTGAACGGTGAAG<br>CGGAAATCTTCTTCCGTCGCTTCCATTCGATAAAGTTGTCCATCCGGCCAAATCAGGCCAT<br>TGATAATAAGAATCCACACGGAAAAAACGCAGTCAACCTTTGAATATGACCTCGTTAAAGACAAACG<br>CTACACGCAAGATAAGTTCTTTTTCCACGTCCCAATCAGCCTCAACTTTAAAGACAAGGGGTTTCAAAG<br>TTTAATGATAAAGTCAATGGGTTCCTCAAGGCAACCCGATGTCAACATTATAGGTATAGACAGGGC<br>GAACGCATCGTCCTTACTTACGTAGTGAATCAGAAAGGTGAAATACGGTTCAGGAATCATTAAAT<br>ACCTTGATGTCGACAAAGGCACGTTAATGATTACCAGCAGAAACTGGATAAAAAGAACAGGAACG<br>TGATGCTGCGCGTAAATCGTGGACCACGGTTGAGAACATTAAAGAGCTGAAAGAGGGGTATCTAAGCCA<br>TGTGGTACACAAACTGGGCACCCTCCATCATTAAATATACCGCAATAGTCTGCCTAGAAGACTTGAATTTT<br>GGCTTTAAACGCGGCCGCTTCAAAGTGGAAAAACAAGTTTATCAAAAATTGAAAAGGCGCTTATAGAT<br>AAACTGAATTATCTGGTTTTTAAAGAAAAGGAACTTGGTGAGGTAGGGCACTACTTGACAGCTTATCAA<br>CTGACGGCCCCGTTCGAATCATTCAAAAATCTGGGCAACAGTCTGGCATTCTGTTTTACGTGCCGGCAG<br>ATTATACTTCAAAAATCGATCCAACAACTGGCTTTGTGACTTCCTGGACCTGAGATATCAGTCGTAGA<br>AAAAGCTAAACAACTTCTTAGCGATTTTAATGCCATTCCGTTTTTAACAGCGTTCAGAATTACTTTGAATTC<br>GAAATTGACTATAAAAAACTTACTCGAAACGTCCGAATCAAAAGGTCATTGGGAACCGAAGAAGTGAACGT<br>TATGGCGAATGTCAGGTATCAGAACCGTCGGAATCAAAAGGTCATTGGGAACCGAAGAAGTGAACGT<br>GACCGAAAAGCTGAAGGCTTCTGTTCGCCAGCAGTTCAAAACTACAACTGATCGATTACGCAAATGA<br>TGATAACCTTGATAGATGTCGATTTTAGAGCAGAGATAAAGGCCAGCTTTTTTAAAGAACTGTTGGCTCCTG<br>AAACTTACGATGACCTTACGACATTCCAAGATCAAATCGGAAAGATGATTTTATTCTGTCACCGGTCAAGA<br>ATGAGCAGGGTGAATTCTATGATAGTAGGAAAGCCGGCAAGTGTGGCCGAAAGACGCCGACGCCAAT<br>GGCGCCTATCATATCGCGCTATCAAAAACCAGGATTGGTTTAGCTTTTAGCTTTATCCAAGAGAAACCGTATCAGGAATGA<br>ACCCTGAATCTGCCTTAGCAGACTAAGGATTTTTTTATCTGAAATTTATTATATCGCGTTGATTATTGATGC<br>GAAATCATCCTTAGCGAAAGCTAAGGATTTTTTTATCTGAAATTTATTATATCGCGTTGATTATTGATGC<br>TGTTTTTAGTTTTAACGGCAATTAATATATGTGTTATTAATTGAATGAATTTTATCATTCATAATAAGTAT<br>GTGTAGGATCAAGCTCAGGTTAATAATTCACTCAGGAAGTTATTACTCAGGAAGCAAAGGATTACAG<br>AATTATCTCATAACAAGTGTTAAGGGATGTTATTTCC |
| SEQ ID NO: 65 | AATCAGGAGAGCGTTTTCAATCCTACCTCTGGCCGCAGTTGATATGTCAAACAGGTTGCCCTCACTGCGTC<br>TTTTACTGGCTCTTCGCTAACCAAACCGGTAACCCGCTTATTAAAGCATTCGTAACAAAGCGGGA<br>CCAAAGCCATGACACAAAAACCGGTAACAAAGTGTCTATAATCACGGCAGAAAAGTCCACATTGATTATT<br>TGCACGGCGTCACACTTGCTACTGCATAGCATTTTATCCATAAGATTAGCCGATCCTACCTGACGCTT<br>TTTATCGCAACTCTCGTGTTCTCCATACCGTTTTTTGGGCTAGCAGTAATACGACTCACTATAGGG<br>GTCTCATCTCGTGTGAGATAGGCGGAGATACGAACTTTAAGAGAGAAGAGTTCACAGTTCACGTATCCGTTGTCAAA<br>CACCATCATACAGGCGGGTCTTCTTAGTATGGACGCCGCCGACGTGGGATAACCTCAGGCTACTTAGCG<br>GAAGACGCCATCGTGCCACAAATCGATATGGATTGCGGAAGAGTTATTGGATGACACATCGTCCTTCC<br>TGAATCGTGTGTTGCCACAAATCGATATGGATTGCGGAGGGCCCTTTGTAAGGTACATAA<br>AAACCCTGGTAATAAAGAACTTGCCCAGGATTACAATGGCCTGTTCGGAAGCCGCCTTAGACCAAGGAGATCAG<br>CGCATATCTTCAGGATGCAGATGCTATAAAGGCCTGTTCGGAAGCCGCCTTAGACGAAGCTATGAA<br>AATTGCGAAAGAAACGGGAACGAAAGTGATATTGAGGTTCTCGAAGCGTTTAACGGTTTAGCGTATA |

TABLE 6-continued

SEQUENCE LISTING

| SEQ ID NO: | Sequence |
|---|---|
| | CTTCACCGGTTATCATGAGTCACGCGAGAACATTTATAGCGATGAGGATATGGTGAGCGTAGCCTACCG
AATTACTGAGGATAATTTCCCGCGCTTTGTCTCAAACGCTTTGATCTTTGATAATTAAACGAAAGCCAT
CCGGATATTATCTCTGAAGTATCGGGCAATCTTGGAGTTGATGACATTGTAAGTACTTTGACGTGTCGA
ACTATAACACATTTTCTTTCCCAGGCCGGTATAGATGACTACAATCACATTATTGGCGCCATACACCGA
AGACGGACTGATACAAGCGTTTAATGTCGTATTGAACTTACGTCGCTACCACAAAAAGACCCTGCTTTGAAA
AATTCAGTTCAAACAGCTCTACAAACAAATCCTGAGCGTGCGTACCAAAGCTACATCCGAAACA
GTTTGACAACTCTAAGGAGAGTGGTTGACTGCATTTGCGATTATGTCAGCAAAATAGAGAAATCGAAAC
AGTAGAACGGGCCCTGAAACTAGTCCGTAATATCAGTTCTTTCGACTTGCGCGGGATCTTTGTCAATAAA
AAGAACTTGCGCATACTGAGCACAAACTGATAGGAGATTGGGACGCGATCGAAACCGATTGATGCAT
AGTTCTTCATCAGAAACGATAAGAAAAGCTATATGATAGCCGGAGGCTTTACGTTGGATGACATC
TTTTCAGCGTGAAAAATTTCTGATGCCTCTGCCAGAAGATATTGCCACAGGCGGAAGACATCTGT
AGAGTGATAAGTGAGACGGCCGTCTCAAAATCGGAGTCCGCTGAGCCGTGACCTGATAGCCTGAACGAC
GATGGTTATGAAGCGGCCGTCTCAAAAATTCGGAGTCGCTGAGCCATTTTACAGCGACCTGAGGAAGTCA
TGGAAATTTTCTCCGTTGGCGTGAGTTCCAAAATGCCAGCATTTTACAGCGACCTGAGGAAGTCA
GCGAACAGCTGATCGAAATTATTCCGTATTCAACAAGGCGTCGTTCTGCACCCGGAAACGCTATA
GCACCGATAAGATTAAAGTGAACTTAAAATTCCCGACCTTGGCGACGGGTGGGACCAATTCTGAATATGAAGAA
AGAGACAACAAAGCCGATTCTGCGAAGACGGTAAGTATTATCTGGCAATTCTGATATGAAGAA
AGATCTGTCAAGCATTAGGACCAGCGACGAAGATGAATCCAGCTTCGAAAAGATGGAGTATAAACTGTT
ACCGAGTCCAGTAAAAATGCTGCCAAAGATATTCGTAAAATCGAAAGCCGCTAAGGAAAAATATGGCCT
GACAGATCGTATGCTTGAACTCGTTGAAATGCTACAGATAAAGGTATGCATAAGGTCGGGTAGTGCGTTTGATCTTGGCTTT
TGCCATGAACTCATTGATTATTACAAGCCGTTGTATCCGGAGTACCCAGGCTGGGATGTGTTCGATTTCA
AGTTTCGCGAAACTTCCGATTATGGGTCCATGAAAGAAGTTCAATGAAGACGTGGCCGAGCCGGTTACT
ATATGAGTCTGAGAAAAATTCCGGTCCAGCGAAGTGTACCCTCTGTAAGACGATGAAATCGATTTATCTATT
TCAAATTATAACAAGATTACTCTGAAAATGCACATGGTAATAAGAACATGCATACCATGTACTGGA
GGGTCTCTTTTCCCCCGCAAAACCTGGAGTCGCCCGTTTCAAGTTGTCGGGTGGGCAGAACTTTTCTTT
CGAAAATCCTCAATCCTAACGATGCCAAAACAGTACACCGAAAGGCTCAGTGCTGGTTCCACGTAAT
GATGTTAACGGTCGGCGTATTCCAGATTCAATCTACCGGAACCTGACACGCTATTTTAACCGTGGCGATT
GCCGAATCAGTGACGAAGCCAAAAGTTATCTTGACAAGGTTAAGACTAAAAAGCGACCATGACATT
GTGAAAGATCGCCGCTTTACCGTGGATAAAAATGATGTTCCACGTCCCGATTGCGATGAACTTTAAGGCG
ATCAGTAAACCGAACTTAAACAAAAAGTCATTGAGACATCATTGATGACATCAGGATCTGAAAATCATT
GGTATTGATCGTGGCGAGCGGAACTTAATTTACGTCACGATGTTGACAGAAAGGGAATAATCTTTATAT
CAGGATTCTCTTAACATCCTCAATGCTACGACATCGTAAAGCTTGATGTGCGGAATATGACAACA
AGGAAGCGCCTCGTAACTGGACTAAAGTGCAGGGCATTCCCAAAATGAAGGAAGGCTATCTGTCATTA
GCGGTTCTCGAAATTAGCGGATATAGCGATTATCGAAAATAACGCCATCATCGTTATGGAGGACCTGAACCAC
GGATTCAAAGCGGCCGCTCAAAGATTGAAAAGACCAAGTTTATCAGAAATTTTGAGAGTATGCTGATTAAC
AAACTGGGCTATATGGTGTTAAAAGACAAGTGCAATGACCAATCAGTGCCGCTGCATGGAATACCAG
CTGGCGAACCATGTTACCACCTTAGCATCAGTTGGAAGCAGTGGGGTTATCTTTTATATACCGGCAG
CGTTCACTAGTAAAATAGATCCGACCACTGGTTTCGCCGATCTCTTTGCCCTGAGTAACGTTAAAACGT
GGATTCCAAAGCATGCCGAATTCTTTTCAAAATGAAAACTGTCATTTATGATAAAGCTGAAGGCAAATTCGC
ATTCACCTTTGATTACTTGGATTACAAGCCGGAATGTGCTGATTACCAGCTGTGGACCGTTTACACC
GTTGGTGAGCGCTTCCAGAAAGCAGGCATTAGCGTCGAAGGAGACTTAAGGACAGAATTGCCGAAAGCGAT
ATGATGCCCTCCAGAAAGCAGGCATTAGCGTCGAAGAGACTTAAGGACAGAATTGCCGAAAGCGAT
GAAGACTACATTCAATCACCTTGGGTGAAAAATGCCCTCTGGGAATTTTTGTTCAAAAATGCTGGTAAAA
GCCTCCCACAAGATAGCAGTGACGCCCCAACGCGGAATCTATTAGACTTCCGCTGATAACATAAAGCCTGGC
TGCTGTCTGAGCAGTACGACCCCAACGCGATGCAAATCGATATCCATCCTAGCGAAGCTAAGGAT
TGACATTCATGCAGTCTGGCATGAAGACCCTGGAAATGCGGAATAATTCACTCAGGAAGTATTACTCAGGAAGCA
TTTTTTATCGAATGATGGGAGACCCTGAAATATATCACTCAGGAAGTATTACTCAGGAAGCA
AAGAGGATTACA |

TABLE 6-continued

SEQUENCE LISTING

| SEQ ID NO: | Sequence |
|---|---|
| SEQ ID NO: 66 | AAAATTCcatGCAAAATGCTCCGGTTTCATGTCATCAAAATGATGACGTAATTAAGCATTGATAATTGAGA<br>TCCCTCTCCCTGACAGGATGATTACATAAATAATGACAAAAATAAATTATTTATTCCAGAAAAT<br>GAATTGGAAATCAGGAGAGCGTTTTCAATCCTACCTCTGGCCACAGTTGATATGTcaaaCAGtTgccgtcactgc<br>gtcattactggctcactcgctaaccaaaccggtaacccgcttattaaaagcattctgtaacaaagcgggaccaaaagccatgcaaaaacgcgtaacaaaagtgtctataat<br>cacggcagaaagtccacattgattatagcacggcgtcaacactagctatgccatagctcagcatattatccataagattagcggatccgatcctacctgacgcattatcgcaactcctactg<br>tactccataccggtatagggctagcaccccgtactcgtgagatagccaactaaagAAGGAGatataccatgGATAGTTTGAAAGA<br>TTTCACCAATCTGTACCCTGTCAGTAAGACATTGAAAGAGGATGAGCATCGTGCAGAAAGTTATCGGAGGGTGAAGAA<br>AATATCGAGAAAGCAGGTATTTTGAAAGAGGATGAGCATCGTGCAGAAAGTTATCGGAGGGTGAAGAA<br>AATAATTGATACTTATCATAAGGTATTTATCGATTCTTCTTGAAAATAGGCTAAAATGGGTATTGAG<br>AATGAAATAAAAGCAATGCTCCAAAGTTTCTGCGAATTGTATAAAAAAGATCATCGCACTGAGGGTGAA<br>GACAAGGCATTAGATAAAATTCGAGCAGTACTTCCGTGGCCTGATTGTTGGGGCTTTCACTGGTGTTGCG<br>GAAGACGGGAAAATACAGTCCAAAACGAGAAGTACGAGAGTTGTTCAAAGAAAAGTTGATAAAAGAA<br>ATTTTACCTGATTTTGTGCTCTCTACTGAGGCTGAAAGCTTGCCTTTCTCGTTGAAGAAGCTACGAGGTC<br>ACTGAAGGAGTTTGATAGCTTTACATCCTACTTTGCTGGTTTTTACGAGGATAGAAGATATATACTCG<br>ACGAAACCTCAATCCACTGCCATTGCTTATCGTCTTATTCATGAGAACTTGCCGAAGTTCATTGATAATA<br>TTCTGTTTTTCAGAAGATCAAAGAGCCTATAGCCAAAGAGCTGGAACATATTCGTGCGGACTTTTCTGC<br>CGGGGGGTACATAAAAAAGGATGGAGATATTTTTTCGTTGAACTATTATATCCACGTGTT<br>ATCTCAGGCTGGGATCGAAAATATAACGCATTGATTGGGAAGATTGTGACAGAGAGATGGGAAGA<br>TGAAAGGGCTCAATGAACACATCAACCTTTACAACCAAAGAGGCAGAGAGGATCGGCTCCCTCTTT<br>TTAGGCCTCTCTTATAAACAGATATTGAGTGACAGAGAGCAATTATCATCTTGCCTGAGTTTTGAAAA<br>AGATGAGGAGCTCTCAGGGCTCTATTTCAAAGAGTTCTATGATCATATCGCAGAAGACATTCTCGGACTAC<br>TCAACAGTTGATGACTTCTATTTCGACAGTAATTATCTCGGATATACCGTAAGGAACGATAGCCAATTG<br>ACTGATAAATCAAAAAAATGTTGGGAGATTGGAATGCTATCTACATGGCTAGAGAACGAGCATATGAC<br>CACGAGCAGGCTCCCAAAAGAATCACGGCGAAATACGAGGGGACCAGGATTAAAGCTCTTAAAGGAGA<br>AGAGAGTATAAGTCTGGCAAATCTTAATAGTTGTATTGCCTTTCTGGACAATGTTAGAGATTGCCGTGTA<br>GATACTTATCTTTCCACACGTGAAAGCAGAATTTGGGCCAGAAGGACTGCTATCTAATCTCGTTGAGAACGTTT<br>TTGCCTTCATACCATAGAGCAATTGTTGAGCTTTCAATACCCCGAAGAGAATAATCTGATTCAGG<br>ACAAGGACAATGTGGTGTTTAATTAAGAATCTTCTGACAATATCAGTGATCTCGAGAGTTCTTGAAAC<br>CTCTTTGGGGTATGGGAGCGAACCCTTGTAACAATAAGGTAAGGAACATGAAAGATTTATGGAGAGTATAATTATATCCGAG<br>GAGCTCTAGATCAGGTGATCCCTTGTAACAATAAGGTAAGGAACTACCTCACTCGGAAGCCTTATTCGA<br>CCAGAAAGTAAAACTAAATTTTCCAATTTCAATTGCTAGTGGTTGGGATAGAAATAAGGAAAAGG<br>ATAATAGCTCGTGATTTTCGTAAGGGCAGAACTTCTATTGGCTATTATGAACAATAGGCACAAAA<br>GAAGTTTCGAAAACAAGGTGTTGCCCGAGTATAAGGAGGAGAACCTTACTTCGAAAAGATGATTATA<br>AATTTTTGCCTGATCCGATCGTAATAAAATGCTTCTAAGGTTTTTCTTTCGAAAAAAGGAATAGAATAATACAA<br>ACCAAGTCCGAAGCTTTAGAACAATATGGAACTCACAAAAAGGAGATACCTTTAGTATGGA<br>TGATTTGCACGAACTGATCGATTTCTTCAAACACTCAATCGAGGCTCATGAAGATTGGAAGCAATTCGG<br>ATTCAATTTCTCTTTCGATACGGCTACTTATGAAAGTTTCGGAATTCTATGTCTAGTTTCATTAATAGAATCAAGGCAAGTTGATTT<br>TATAAGCTCAGATATACAACAAGGACTTTTCTCCCTGACGACCAAAAGGACCACCTTATAATAGATACCTTGTATTGG<br>AGAATGCTTTTGACGAGCCAATTTGGCAGATCATCATATACAAAACTGGATGGGAAGGCTGAAATCTTT<br>TTCCGAGAGAAGAGTTTGAAAAATGATCATCCCACGACATTTAGTCAAGGATAGCCACTATACGATGGA<br>CGACAAAAAAAGGAGGAGTCTTGTTTGAGTATGATTTAAATGTTCTCAGGAAGCAAAGTCAATGATATG<br>TAAGTTCCAGTTTCATGTCCTATTACTATGAATTTAAATGTTCTCAGGAAGCAAAGTCAATGATATG<br>GTTAATGCTCATATTCGAGAGGCAAAGAATATGCATGTCATTGGAATTGATCGTGAGAACGCAATCTG<br>CTGTATATATGCCGTGATAGATAGTCGAGGGACGATTTTGGATCAAATTTCTCTGAATACGATTAACGATA<br>TAGACTATCATGATTTATTGGAGAGTGGAGACAAAGACCCTCAGCAGGAGCGCCGAAATGGCAACTA<br>TCGAAGGGATCAAGGAGCTAAAACCAGGCTACCTTAGTCAGGCGGTTCATCGGATAGCCGAACTGATGG<br>TGGCTTATAAGGCTGTAGTTGCTTTGGAGGATTTGAATATGGGGTTCAAACGTGGCGCAGAAAGTAG |

TABLE 6-continued

SEQUENCE LISTING

| SEQ ID NO: | Sequence |
|---|---|
| | AAAGTTCTGTTTATCAGCAGTTTGAGAAACAGCTGATAGATAAGCTCAACTATCTTGTGACAAGAAGA |
| | AAAGGCCTGAAGATATTGGAGGATTGTTGAGAGCTATCAATTTACGGCCCATTTAAGAGTTTTAAGG |
| | AAATGGAAAGCAAAACGGCTTCTTGTTTATATCCGGCTTGGACACGACCAACATAGATCCGACTA |
| | CTGATTTGTTAATTTATTTCATGCCCAGTATGAAAATGTAGATAAAGCGAAGAGCTTCTTCAAAAGTT |
| | TGATTCAATTAGTTACAACCCGAAGAAAGACTGGTTTGAGTTTGCATTCGAATATAAAACTTTACTAAA |
| | AAGGCTGAAGGAAGTCGTTCTATGTGGATATTATGCACACATGGTTCCCGAATAAAGAAATTTAGAAAT |
| | TCCCAGAAGATGGTCAAATGGATTCCGAAGAATCGCCTTGACCATGGTTCAATGTTCTTTTTGTGC |
| | GATATGAGATAGATTATACCGCTGATTTGAAAACAGCTATTGTGGACGAAAAGCAAAAGACTTCTTCG |
| | TGGATCTTCTGAAGCTATTCAAATTGACAGTACAGATGCCGCAACAGCTGGAAGAGAAGGAATTAAAGTCTGC |
| | ATCTAATCTCTCGTGTAGCAGGGCTGATGGCCGTTTCTTCGATACAAGAAGGAAATAAAAGTCTGC |
| | CTAAGGATGCAGATGCCAATAGCCCTAAAAGAACTTTGGGCTTACGCCAGATTC |
| | GGCAAACTTCAGAAGGCGTAAACTCAAATTGGCGATTTCCAATAAGGAATGCTACAGTTGTGCAAG |
| | AGAGATCTTACGAGAAAGACtgaGAAAATCATCCTTAGCGAAAGCTAAGATTTTTTATCTGAAATTTAT |
| | TATATCGCGTTGATTATTGATGCTCGTTTTTAGTTTTTAACGCAATAATAATAGTGTTATTAATTGAATGA |
| | ATTTATCATTCATATATAAGATATGTAGGATCAAGCTCAGGTTAAATATTCACTCAGGAAGTTATTACT |
| | CAGGAAGCAAAGAGGATTACAGAATTTACATCATAACAAGTGTTAAGGATGTTATTTCC |
| SEQ ID NO: 67 | AAAATTCatGCAAAATGCTCCGGTTTCATGTCATCAAAATGATGACGTAATTAAGCATTGATAATTGAGA |
| | TCCCTCTCCCTGACAGGATGATTACATAAATAATAGTGACAAAAATAAATTATTTATTCATCCAGAAAAT |
| | GAATTGGAAAATCAGGAGAGCGTTTCAATCCTACCTCTGCGCAGTTGATATGTcaaaCAGGTgccgtcactgc |
| | gtcattactggctcactcgtcgtaacaaaccggtaaccccgcttattaaaagcattctgtaacaaagcggaccaaagccatgacaaaaacgcgtaacaaaagtgtctataat |
| | cacggcagaaagtccacattgattatagcacggcgtcaactagctatgccaactagctatgccatgcaaaaagattagcggatcctaccttgacgcattatcgcaactctctactg |
| | tactccataccgttataggggctagcaccgttagcaacagctatgcaacaataaagaAAGGAGatataccATGAACAACGGCACAA |
| | ATAATTTCAGAACTTCATCGGATCTCAAGTTTGCAGAAAACGTGCCAATGCTCTGATCCCACGGA |
| | AACCACGCACAGTTCATCGTCAAGAACGGAATAATTAAAGAAGATGAGTTACGTGGCGAGAACCGCC |
| | AGATTCTGAAAGATATCATGGATGACTACTACCGCGGATTCATCTCTGAGACTCTGAGTTCTATTGATGA |
| | CATAGATTGGACTAGCCTGTGTGAAAAATGGAAATTCAGCTGAAAAATGGTGATAATAAAGATACCTT |
| | AATTAAGGAACAGACAGAGTATCGGAAAGCAATCCATAAAAAATTGCGAACGACGATCGGTTTTAAGA |
| | ACATGTTTAGCGCCAAACTGATTAGTGACATATTACCCTCTGAATTTGTCATCCACAACAATAATTATTCGGC |
| | ATCAGAGAAAGAGGAAAAAAACCCAGTGACTCTTTTCAGCGGACGATATTTCCTCGGGCTGCCATCGTCAAC |
| | CTTCAAGAACCGTGCAAATTGCTTTTCTTTCATCAAGCAGCTGCCATCGCCATCGTCAAC |
| | GACAATGCAGAGATATTCTTTTCAATGCCGTCTCTACCCGCGGAGTCGTAAAATCGCTGAGCAATGAC |
| | GATATCAACAAAATTTCGGGCGATATGAACGATTCATTAAAAGAAATGAGTCTGGAAGAAATATATTCT |
| | TACGAGAAGTATGGGGAATTTATTACCCAGGAAGGCATTAGCTTCTATAATGATATCTGTGGGAAAGTG |
| | CACAACAGATTCTATGCATTGCGAACATATGAGGTCCCGTATAAATTGAGCTCCGTATAAATTTGAAAGTGACGAGGA |
| | GTGTACCAATCAGTTAACGGCTTCCTTGATAACATTAGCAGCAACATATGTCGAAAGATTACCCAAA |
| | ATCGGCGATAACTATTAACGGCTACAACCTGGATAAAATTTATATCGTCCAAATTTACGAGAGCGTTA |
| | GCCAAAAAACCTACCGCGACTGGGAAACAATTAATACCCCCTGAAATTCATTACAATATATCTTGC |
| | CGGGTAACGTAAAGTAAAAGTAAGCGGACTAAAAAAGCGGTTAAGAATGCGTTAACAGAAATCCATC |
| | ACCGAAATAAAGTAGTTGTCAAACTATAAGCTGTGCAGTGACGACAACATCAAAGCGGAGACTTAT |
| | ATAATGAGATTAGCCATATCTGAGCTGAGTGAGTTTAAAAACGTGCTGGACGTGAACATCCGGAATGCGTTTCAT |
| | TGGTGTTCCGTTTTTATGACTGAGCGAGCTTAAAGCACAACAATTTTATGCGGAACTGAGGAGA |
| | TTTACGATGAAAAAGATTAATCCAGTAATTAGTCTGTACAACCGGTCGTAACGGTCCAGAACCGTA |
| | CAGCAGCGAAAAGATTAAATTGAACTTTGGACTACAGGCATGCCGACAATCTGTATTATCTGGGCATCTGTATCCAGAAAAGA |
| | GTAATTCTAATAACGCTATCATCGATGCCGCAATACGTCAGAAAGTTTCAGAAAATAAGGGTGACTACAAAAGATGATTTA |
| | AAACCGGACAAGAAGATTATCGAGGGTAATACGATCCCGAAAGTTTTCAGAAAATGATGATTTA |
| | TAATTTGCTCCCGGGTCCCCAACAAAATGATCCCGAAAGTTTCTTGAGCAGCAGCGAAAGGGGTGAAAC |

TABLE 6-continued

SEQUENCE LISTING

| SEQ ID NO: | Sequence |
|---|---|
|  | GTATAAACCGAGCGCCTATATCCTAGAGGGGTATAAACAGAATAAACATATCAGTCTTCAAAAGACTT<br>TGATATCACTTCTGTCTTCATGATCGATCGACTACTTCAAAAACTGTATTGCAATTCTGAGTGGAAA<br>AACTTCGGTTTGATTTAGCACACCAGTACATTATGAAGACATTTCCGGTTTATCGTGAGGTAGAGT<br>TACAAGGTTACAGATTGATTGGACATACATTAGCGAAAAAGACATTGATCTGCTGCAGGAAAAAGTC<br>AACTGTATCTGTTCCAGATATAACAAGATTTTCGAAAAATCAACCGGGAATGACAACCTTCACA<br>CCATGTAACCTGAAAAATCTTTCTTCAGAAGAAAATCTTAAGGATATCGTCTGAAACTTAAGGCGAAG<br>CGGAAATCTCTTCTGAAGAAGCAGCATAAAGAACCCAGTTTGGCAACATTCAAATTGTGCTAAAAATATTCCGG<br>ACCGTACCTACGAAGCAGCAGAAAAAGACCAGTTTGGCAACATTCAAATTGTGCTAAAAATATTCCGG<br>AAACATTTATCAGGAGCTGTACAATATCTTCAACGATAAAGCGACAAAGAGCTGTCTGATGAAGCAG<br>CCAAACTGAAGAATGTAGTGGGACACCACGGAGCAGCGACGAATATAGTCAAGGACTATCGCTACACG<br>TATGATAAATACTTCCTTCATATGCTATTACGATCAATTCAAAGCCAATAAAACGGGTTTATTAATG<br>ATAGGATCTTACAGTATATCGTAAAGAAAAAGACTTACATGTGATCGGCATTGATCGGGCGAGCGTA<br>ACCTGATCTACGTGTCCGTGATTGATACTTGTGGTAATATAGTTGAACAGAAAAGCTTTAACATTGTAAA<br>CGGCTACGACTATCAGATAAAACTGAAACACAGGAGGGCGTAGACAGATTGCGCGAAAGAATGGA<br>AAGAAATTGGTAAAATTAAAGAGCACATAAAGAGCTACCTGAGCTTAGTAATCCACGAGATCTCTAAAA<br>TGGTAATCAAATACAATGCAATTATAGCGATGAGGATTTGTCTTATGGTTTAAAAAAGGCGCTTTAA<br>GGTCGAACGGCAAGTTACCAGAAATGGCGGTCTCGAAAGGTTATCCGACATACCAACTATCTGGATTTAA<br>AGATATTTCGATTACCGAGAATGGCGGTCTCCTGAAAGGTTATCCGACATACCAACTATCTGGATTTAA<br>AAAAACGTGGGTCATCAGTGCGCTGCATTTTTATGTGCCTGCATACACGAGCAAAAATTGATCCGA<br>CCACCGGCTTTGTGAATATCTTTAAATTTAAAGACCTGACAGTGACGCAAAACTGAATTCATTAAAA<br>AATTTGACTCAATTCGTTATGAGCAGTGAAAAAATCTGTTCTGCTTTACAATTGACTACAATAACTTATT<br>ACGCAAAACACGGTCATGAGCAAATATCGTGGAGTGTATACATACCGGCGTGCATCAAACGTCGC<br>TTTGTGAACGGCCCGCTTCTCAAACCAAAGTGATACCATTGACAATTGACATAACAAAAGATATGGAGAAAACGTTG<br>GAAATGACGGACATTAACTGGCGCCATGGCCACGATCTTCGTCAAGACATTATAGATTATGAAATTGTT<br>CAGCACATATTCGAAATTTCCGTTTAACAGTGCAAATGCGAAATGACAAATAACATTTTTATGACAGCGCAAAGCCGTG<br>ATTACGATCGTCTCATTTCACCTGTACTGAACAGAAAAATAACATTTTTATGACAGCGCAAAGCCGTG<br>ATGCACTTCCTAAGGATGCCGATGCAAATGGTGGCTATTGTATTGCATTAAAAGGGTTATATGAAATTAA<br>ACAAATTACCGAAAATTGGAAGAAGATGTAAATTTCGCGCGTAAACTCAAAATCAGCAATAAAG<br>ATTGGTTCGACTTTATCCAGAATAAGCCTATCTCAGAGAAATCATCCTTAGCGAAAGCTAAGGATTTTT<br>TTTATCTGAAATTTATTATATGCGTTGATTATTGATGCTGTTTTTAGTTTTACGGCAATTAATATATGT<br>GTTATTAATTGAATGAATTTTATCATTCATAATAAGTATGTGTAGGATCCAAGCTCAGGTTAAATATTCAC<br>TCAGGAAGTTATTACTCAGGAAGCAAAGAGATTACAGAATTATCTCATAACAAGTGTTAAGGGATGTT<br>ATTTCC |
| SEQ ID NO: 68 | AATCAGGAGGAGCGTTTTCAATCTACCTCTCGGCCGCAGTTGATATGTCAAACAGGTTGCCGTCACTGCGTC<br>TTTTACTGGTCTTCTCGCTAACCAACCAGTAACCCCGCTTATTAAGCATTCTGTAACAAAGCGGGA<br>CCAAAGCCATGACAAAAACCGCGTAACAAAACCGTCTATAATCACCGCAGAAAAGTCCACATTGATTATT<br>TGCACGGCGTCACACTCCTCTACTGTTTCTCCATACCCGTTTTTTTGGGCTAGCAGTAATACGACTCACTATAGGG<br>GTCTCATCTCGTGAGATAGGCGGAGATAGACGAACTTTAAGAGGAGGAATATACCATGCACCATCATCAT<br>CACCATACCAATAAATTCACTAACCAAGTATTCTCTCTTAAGACCCTGCCTTTGAACTGATTCCGCAGG<br>GGAAAACCTTGGAGTTCATTCAAGAAAAAGGCCTTCTTGTCTCAGGATAAACAGAGGGCTGAATCTTACC<br>AAGAATGAAGAAACTATTGATAAGTTTCATAAATATTTCATCAGAATTTGATTTAGCCTTGTCTAACGCCAAATT<br>AACTCACTTGGAAACGTATCTGGACTTATACAACAAATCTGCGAAAGCAAATGTCAAATCCTTCAGTGACGCGATGC<br>AGACGATTTGAAAAAAGTACAGGACAATCTGCGTAAAGAATGTTCAAATCCTTCAGTGACGGCGATGC<br>TAAAAGCATTTTTGCCATTCTCGACCAAAAAGAGTTGATTACTGTGGAATTAGAAAAGTGGTTTGAAAA<br>CAATGAGCAGAAGACATCTACTTCGATGAGAAATTCAAAACTTTCACCACCTATTTACCAGGATTCAT<br>CAAAACCGAAGAACATGTACTCAGTGAGACGAACTCCACGGCCATTGCTATCGTTTGATCCATGAG<br>AATCTGCCTAAATTTCTGGAGAATCGAAAGCTTTGAAAAGATTAAGCAGGTCGAATCGCTGCAAGTG |

TABLE 6-continued

SEQUENCE LISTING

| SEQ ID NO: | Sequence |
|---|---|
| | AATTTTCGTGAACTCATGGGCGAATTTGGTGACGAAGGTCTAATCTTCGTTAAGCAACTGGAAGAAATG
TTTCAGATTAATTACTACAATGACGTGCTATCGCAGAACGGTATCACAATCTACAATAGTATTATCTCAG
GGTTCACAAAAAACGATATAAAATCAAAGGCCTGAACGGTATATCAACTACAACTACAACCAAACAAAG
GACAAAAAAGGATAGGCTTCCGAAACTGAAGCAGTTATACAAACAGATTTTATCTGACAGAATCTCCTG
AGCTTTCTGCCGGATGCTTTCACTGATGGGAAGCAGGTTCTGAAAGCAGTTTCGATTTTCATTTTATAAGATTA
ACTTACTGAGCTACACGATTGAAGGTCAAGAAGAATCTCAAAACTTACTGCTCTTGATCCGTCAAACCAT
TGAAAATCTATCATCGTTCGATACCGAAAAACTTACCTCAAAACGTAAAACGTACTCACCTGACTACGATCTCT
CAGCAGGTTTTCGGGGATTTTAGTGTATTTTCAACAGCTCTGAACTACTGGTATGAAACCAAAGTCAATC
CGAAATTCGAGACGGAATATTCTAAGGCCAACGAAAAAAAACGTGAGATTCTTGATAAAGCTAAAGCC
GTATTTACTAAACAGGATTACTTTTCTATTGCTTTTCCTGCAGGAAGTTTTATCGGAGTATATCCTGACCCT
GGATCATACATCTGATATCGTTAAAAAAACAGCAGCAATTGCTGCTAATTCAAAAACCACTTT
GTCGCCAAAAAAGAAAACAGAAAACAGACAAGACTTTCGATTTCATTGCTAACATCACCGCAAAATACCAG
TGTATTCAGGGTATCTTGAAAAACGCGACCAATACGAAGAGAACTGAAACAGATCAGAAGCTGATC
GATAATTTAAAATTCTTCTTAGATGCAATCCTGGAGCTGCTGCACTTCATCAAACCGCTTCATTTAAAGA
GCGAGTCCATTACCGAAAAGGACACCGCTTCTATGAAGACGTTTTGAAAATTATTATGAAGCCCTCTCCTT
GCTGACTCCCGTGTATAATAGTGTACGCAATTACGTAACCCAGAAACCATATTCTACCGAAAAAATTAA
ACTGAACTTTGAAAACGCACAGCTGCTCAACGGTTGGGACGCGAATAAGAAGTGACTACCTCACCAC
CATCCTGAAAAAAGATGGTAACTATTTTCTGGCAATTATGGATAAGAACATAATAAAGCATTCCAGAA
ATTTCCTGAAGGGAAAGAAAAAATTACGAAAGAAATGTGTATCAAACTCTTACCTGGAGTTAACAAAATGTT
GCCGGAAAGTATTTTTTAGTAATAAGAACATCGCGTACCTTTAACCTGGAACATTGCCATACTTAATAGACTTCTTC
AAAAAGGAGACGCATAAGAAACGCGAGAGATTGGAATATTTCGATTTTCAGTTTAGTGAGACCAAGTCATAC
CAGGATTCTTAGCGCGCTTTTATCGCCAAGTAGAACACCAAGCTATAAAATTAACTTCAAAACATCGAC
AGCGGAATACATCGACGGTTTAGTTAACGAGGGCAAACTGTTTCTGTTCCAGATCATTATCAAAGGATTTTA
GCCCGTTCTCTAAAGGCAAACCAAATATGCATACGTGAAAGCAGCACTGTTTGAAGAGCAAAACC
TGCAGAATGTGATTTATAAACGAACGGCCAAGCTGAGATTTTTTCCGTAAAGCCTCGATTAAACCAAA
AAATATCATCCTTCATAAGAAGAAAATAAAGAACTTGAATATGTACTACCAGGCAAGATATCGAAA
CCTCCGAAATAGTGCCTGTTCAAACAATTAAGAAACTTGAATATGTACCAGGCAAGATATCGAAA
AGGAGTTGACTCAAGACGATCTTCCCTATATCGATTCAAACAATTTTGATAATATGTACTATTTTAACGAAAAACAAGACGA
TCGACATCATCAAAGATAAAACGCTTCACTGTAGATAAGTTCCAGTTTCATGTGCCGATTACTATGAACTT
CAAAGCTACCGGGGTAGCTATATCAACCAAACCGGTGTTGAATAACCTGCAGAATAACCCGGAAGTCAA
AATCATTGGGCTGACCGCGGAGAACGTCACCTTGTACTTGACCTTAATCGATCAGCAAGGCAACAT
CTTAAAACAAGAATCGCTGAATACCATTACGGATTCAAAGATTAGCACGTACCCGTATCATAAGCTGCTCGA
TAACAAGGAGAATGAGCGCGACCTGGCCTGAATAAAACTGGGCACGGTGGAAAACATTAAGGAGTTAA
AGGAGGGTTATATTTCCCAGTAGTGCATAAGATCGCCACTTCATGCTCGAGGAAAATGCGATCGTTG
TCATGGAAGACTTAAACTTCGGATTTAAACGGTGATTTAAAGTAGAGAACAAATCTACCAGAAGT
TAGAAAAAATGCTGATTGACAAATTAAATTACTTGGTCTCTAAAAGACAAACAGCCGCAAGAATTGGTG
GATTATACACGCCCTCCAACTTACCAATAAATTCGAAAGTTTCAGAAAATGGTAAACAGTCAGGCT
TTCTTTTATGTTCCTGCCGTGGAACACATCCAAAATCGACCCTACAACCGGCTTCGTCAATTACTTCTAT
ACTAAATATGAAAACGTCGACAAGCAATCATTCTTTGAAAATCTCAGAACAATACGTTTTAACGCT
GAGAAAATATTTCGAGTTCGAAGTCAAGAAACGTCCCAAAGAAGATCAGAATAACAA
CAAGCGTGACAATCGCACCTACGGCGAGCGCATCGAAGAAGGTTCTTAGGTAAAAATCAGATTGTTAT
ATTTGTTCAACACCTTATCAACCTGACCGAAGGATTTGAAGACTTCTTAGGTAAAAATCAGATTGTTAT
GGCGACGGTAACTGTATAAAAATCTCAAAAGCCTCAAAGGATGATAAAGCATTTTTCGAAACATTATTA
TATTGGTTCAAAATGACACTGCAGATGCCAATAGTGAGCGCGTACAGATATTGATTATCTTATCAGCC
CGGTCATGAACGACAACGGTACTTTTACAACTCCAGAGACTATGAAAAACTTGAATCCAACTCTCC
CCAAAGATGCTGATGCGAACAACGGTTGCTTATCATCGGAAAAAGGTCTGATGCTGCTGAACAAAATCG
ACCAAGCCGATCTGACTAAGAAAGTTGACCTAAGCATTTCAAATCGGGACTGGTTACAGTTTGTTCAAA |

TABLE 6-continued

SEQUENCE LISTING

| SEQ ID NO: | Sequence |
|---|---|
| | AGAACAAATGAGAAATCATCCTTAGCGAAAGCTAAGGATTTTTTATCGAAATGTAGGGAGACCCTC |
| | AGGTTAAATATTCACTCAGGAAGTTATTACTCAGGAAGCAAAGAGGATTACA |
| SEQ ID NO: 69 | AAAATTCcatGCAAAATGCTCCGGTTTCATGTCATCAAAATGATGACGTAATTAAGCATTGATAATTGAGA |
| | TCCCTCTCCCTGACCAGGATGATTACATAAATAGTGACAAAATAATTATTTATTTATCCAGAAAAT |
| | GAATTGGAAAATCAGGAGAGCGTTTTCAATCCTACCTACCTCTGGCCGCAGTTGATATGTcaaaCAGGTtgccgtcactgc |
| | gtcattactggctcactcgctgaccgtcacccgtaaccccgcctattaaaagcattctgtaacaaagcggaccaaagccatgacaaaacgcgtaacaaaagtgtctataat |
| | cacggcagaaaagtccacattgattatagcacggcgtcacactagctatgccaatagcattatccataagattagcggatcctcacctgacgcattatcgcaactctctactg |
| | tactccatacccgttataggggctagcaccgcctatctcgtgtgaagtaggcggagatacgaactaaagAAGGAGatataccATGGAACAGGAATATT |
| | ATCTGGGCTTGGACATGGCACCGGTTCCGTCGGCTGGCTGTTACTGACCAGTGAATATCACGTTCTAAG |
| | AAAGCATGGTAAGGCATTGTGGGGTGTAAGCACTTTTCGAATCTGCTTCCACTGCTGAAGAGCGTAGAAT |
| | GTTTAGAACCAGTCCACGTAGGCTAGACAGGCGCAATTGGAGAATCGAAATTTTACAAGAAATTTTTGC |
| | GGAAGAGATATCTAAGAAAGACCCAGGCTTTTTCCTGAGAATGAAGGAATCTAAGTATTACCCTGAGGA |
| | TAAAAGAGATATAAATGGTAACTGTCCCGAATTGCCTTACGCATTATTTGTGGACGATGATTTTACCGAT |
| | AAGGATTACCATAAATAAAAGTTCCCAACATTACGCAAAATGTTAATGAATACAGAGGAAACC |
| | CCAGACATAAGACTAGTTTATCTGGCAATACACCATATGATGAAACATAGAGGCCATTTCTTACTTTCCG |
| | GGGATATCAACGAAATCAAAGAGTTTGGTACCACATTTAGTAAGTTACTGGAAAACATAAAGAATGAAG |
| | AATTGGATTGGAACTTAGAACTCCGGAAAAGAAGAATACACGGCGGTTGTCGAATCTATCCTGAAGGATAATA |
| | TGCTGAATAGGTCGACACCAAAAAACTAGGCTGATCAAAGCACTGAAGCCAAATCTATCTGCGAAAA |
| | GCTGTTTAATTTACTTGCTGGTGGCACTGTTAAGTTATCAGACGATTTTTGGTTTGGAAGAATTGAACG |
| | AAACCGAGCGTCCAAAAATAGTTTCGCTGATAATGGCTACGCAGTCATTGATTACATTGGTGAGGTGAAAACG |
| | AGTTGGGCGAACAATTTATTATTAGAGACAGCTAAGGCACTCTATGACTGGCAGTGTTTTAGTAGAAA |
| | TCCTTGGTAAATACACCATCTATCTCCGAAGCCAAAGTTGCTACTTACGAAAAGCCAAGTCCGATCTCCA |
| | GTTTTGAAGAAAATTGTCAGGAAAATATCGACTAAGGAGAATAAAGATATTTTCGTTAGTATCCTCT |
| | GACAAACTGAAAATTACTCCCGCTTACATCGGATGACCAAGATTTCATTAAAAGAATGTCTAAAAATTAGAAGGT |
| | AGCAAAAGGTGTTCGAAGGAAGAATTTATGATTTCATTAAAAGAAGAGACATTCTTAAAACAAGTCAACAG |
| | CAGCAGAATACGAATATTTGAAAGAAGAATCTGACAAAAGAGAAAATTTAGGCATTTACGCGAT |
| | AAAATTGACCTTATCAAAGAAATGAGGATAAGCTGGTTCAACTCTTTGAATTCAGAATACCCTATTATG |
| | TGGGCCCACTGAACAAGATTGATGACGGCAAAGAAGGTAAATTCACATGGCCGTCCGCAAATCCAATG |
| | AAAAATTTTACCCATGGAACTTTGAAATGTAGTAGATATTGAAGCGTCTGCGGAGAAATTTATTCGAA |
| | GAATGCTAATAAATGCACTTACTTGATGGAGAAGATGTTCTGCCTAAAGACAGCTTATTATACAGCA |
| | AGTACATGGTTCTAAACGAACTTAACACCTTAAGTTGGACGGTGAGAAATTAAGTGTAGAATTGAAAC |
| | AAAGATTGTATACTGACGTCTTTCTGGAAACGTTCTGCAAGTACAGAAAAGTGACAGTTAAAAATTAAGAATTACTTGA |
| | AGTGCGAAGTATAATTTCTGGAAACTAGAGATTACTGGATTATGGTGATTTCAAAGCATCCTAA |
| | CAGCTTACCACGATTTCAAGGAAAATCCTGACAACTGCAAAAAAAGATAAGAAAACATT |
| | ATTACTAATATTGTTCTTTTCCGTGATGACAAGAAATTGTTGAAGAAAGACTGAATAGACTTTACCCCC |
| | AGATTACTCCCAATCAACTTAAGAGAAATTTGTGCTTTGTCTTACCAGGATGGGGTCGTTTTCAAAAAA |
| | GTTCTTAGAAGACAACAATATCTTTATGCAACTTCTGAGAAATCAGGCGAATATGGAATATAATTACCGCCTTATG |
| | GGAATGCGAACAATAATCTTATGCAACTCTGACCACTTCTGAGGAGAATATCTTCATGGAAGAAGTTGAGACTTA |
| | CAACATGGGCAAAATTTGCCAAACCTTAAAATTGTCCATGTGGAAAATATGTATGAAGGTTATCACCTTCTGT |
| | CAAGAGACAAAATTTGGCTAGAAGAAAAATGTCAAGAGAAAAATGTGGTAAAGGAGAACCAAGTCAAGAAGAAGCAG |
| | AACGTGTTTATTGAAATGGCTAGAAGAAAATGTCAAGAGAAAAATGTGGTAAAGGAGAACCAAGTCAAGAAGAAGCAG |
| | TTAATCGATTTATATAAGGCTTGTAAAACAAGAAAATGTGGTTAAGAAAATTGGGGGGACCAAGA |
| | GGAACAAAAACTACGGTCGGATAAGTTGTATTTATACAAGAAATGATATACGCAAAGGACGATGTATGTATTCGG |
| | CGAGGTAATAGAATTGAAGGATTTATGGCAATACAATACAAAATGACCATAGACCATATATATCCCCAATC |
| | AAAAACATGGACCGATAGCTTAACAATAGAGTACTCGTGAAAAAAATATATATCGACCAAATCTG |
| | ATAAGTATCCTCTGAATGAAAATATCAGACATGAAAGAAGAAAAGGGGTTCTGAAGTCTCTGTTAGATGGTG |
| | GGTTTATAAGCAAAGAAAAGTACGAGCGTCTAATAGAAAAAACACCGAGTTATCGCCAGAAGAACTGCT |

TABLE 6-continued

SEQUENCE LISTING

| SEQ ID NO: | Sequence |
|---|---|
| | GGTTTATTGAGAGGCAAATCGTGAAACGAGACAATCTACCAAAGCCGTTGCTGAGATCCTAAAGCAA |
| | GTTTTCCCAGAGTCGGAGATTGTCTATGTCAAAGCTGGCCACAGTGAGCCAGGTTTAGGAGAAGACTTCGAA |
| | CTATAAAGGTAAGAGAAGTGAACGATTTACATCGCCAAGGACGCTTACCTAAGAATATCGTTGTAGGT |
| | AACTCATATTATGTTAAATTTACCAAGAACGCCTCTTGGTTTATAAAGGAGAACCCAGTAGAACATAT |
| | AACCTGAAAAAGATGTTCACCTCTGGTTGACAGTAAAGCAAATTATGAGAGAACAAAATAATACCTCGTTACAAGCAGGT |
| | AAGAAAGGGACTATAGTGACAGTAAAGCAAATTATGAGAGAACAAAATAATACCTCGTTACAAGCAGGT |
| | TCATGAAGCAAATGGCGGCCTTTTTGACCAATCAAATTATGACAGAAGATGAAAGGTCAAATTGCAATAA |
| | AAGAAACCGATGAGAGACTAGCGTCAATAGAAAGATGTGGCTATAATAAAAGCTGCGGGTGCATAC |
| | TTTATGCTTGTTGAATCAAAAGACAAGAAAGGTAGAACTATTAGAACTATAGAATTTATACCCCTGTACC |
| | TTAAAACAAAATTGAATCGATAGAGTCAATCGCCGTAAATTTCTAGAGAAGGAAGGGGTTTAAAAG |
| | AACCAAAGATCCCTGTTAAAAAGATTAAGATTGACACCTTGTTCGATGTAGATGATTTAAAATGTGGT |
| | TATCTGGCAGAACAGGCGATAGAGTTTTGTTTAAGTGCGCTAAGTCAATTAATTTTGGATGAGAAAATCAT |
| | TGTCACAATGAAAAAATAGTTAAGTTTATTCAGAGAGCAAGAACAAGGAGTTGAAATTATCTGA |
| | TAAAGATGGTATCGACAATGAAGTTTTAATGGAAATCTACAATCATTCGTTGATAAACTTGAAAATAC |
| | CGTATATCGAATCAGGTTAAGTGACACAAGCCAAAACATTAATTGATAAACAAAAGAATTGAAAGGCT |
| | ATCACTGGAAGACAAATCCTCCACCCTATTTGAAATCTACAATCTCCAGTGATGAACAATAATATCTCCAAGTGT |
| | AATTTAAAAATGATTGGCCGACCTGGGAAAGCCGGACTCCAGGTATTTTGAAAATAGACTTGCTTAAGATAT |
| | AAGAAATCATCCTTAGCGAAAGCTAAGAGATTTTTTTATCGAAAATTTATTATATCGCGTTGATTATTGAT |
| | GCTGTTTTAGTTTTAACGGCAATTAATATATGTGTTATTAATCAGGAAGTTATTACTCAGGAAGCAAAGAGGATTAC |
| | ATGTGTAGGATCAAGTCAGGTTAAATATTCACTCAGGAAGTTATTACTCAGGAAGCAAAGAGGATTAC |
| | AGAATTATCTCATAACAAGTGTTAAGGGATGTTATTTCC |
| SEQ ID NO: 70 | AATCAGGAGAGCGGTTTTCAATCCTACCTCTGGCCAGTTGATATGTCAAACAGGTTGCCGTCACTGCGTC |
| | TTTTACTGGCTCTTCTCGCTAACAAAACCGGTAACCCGTATAATCACGGCAGAAAGCATTCGTAACAAGCGGGA |
| | CCAAAGCCATGACAAAACGGTAACAAACGGTCTATAATCACGGCAGAAAGTCCAGAAAAGTCCAATTGATTATT |
| | TGCACGGCCGTCACACTTCTACTCTTCCATAGCATAGCATTTTATCCATAAGATTAGCGGATCCTACCTGACGCTT |
| | TTTATCGCAACTCTCGTCTACTGTTTCTCCATACCCGTTTTTGGCTAGCAGTAATACGACTCACTATAGGG |
| | GTCTCATCTCGTGTGAGATAGGCGGAGATACGAACTTTAAGAGGAGGATAATACCATGCACCATCATCAT |
| | CACCATTCTTTCGACTCTTTCACCAACCTGTACTCTCTGTCTAAAACCCTGAAATTCGAAATGCGTCCGGT |
| | TGGTAACACCCAGAAAATGCTGGACAACGCGGGTGTTTTCGAAAAGAACAAACTGATCCAGAAAAAT |
| | ACGGTAAAACAAACGTACTTCGACCGTCGACCGTCTGCGAATTCATCGAAGAAGCGCTGACCGGTGTTG |
| | AACTGATCGGTCGGACGAAAACTCTCTGCAGCGTCTGCAGCTACCGGAATCGGTAAATATCTTCAACCTGTTCG |
| | CGATGAAAGCGTACGAAAACGTAAAACAAATACCCGATCCTGGGTCTGAAAACAAAAACACATCCTGTTCG |
| | CGGAGACTGGGTTAAAACAAATACCCGATCCTGGGTCTGAAAACAAAAACACATCCTGTTCG |
| | AAGAAGCGGTTTTCGGTATCCGAAGCGCGTTACGGTGAAGAAGAGACACCTTCATCGAAGTTGAAG |
| | AAATCGACAAAACCGGTAAAACCGTAAATCTAAAATCAACCAGATCCTATCTTCGAAAGGTTTCACCG |
| | GTTACTTCAAAAATTCTTCGACCAGAACTTCATCGACAAACGACGGTATCCTGTATCGTTGAATCTGTTCGTCA |
| | CGACCCGTATCATCGACCAGAACGTTGACGACGGTATCCGACTACTACACAAATCATCGGTGTGAAACCCTGAGAA |
| | GAAAGTTGACCGGCGAAACCGAAACATCTTCTCTATCCTCTGTCTGCAGTTCTTCTCTCTCAGTTCTTCTCTATCGACTTCT |
| | ACAACAAAATGCCTGCTGCAGGACGGTATCGACTACTACACAAATCATCGGTGTGAAACCCTGAGAA |
| | ACGGTGAAAACTGCTGGTCTGACAAACAGATCTGTTGAACAACAGTACCGTCAGAACAACAAGACCAGAAA |
| | ATCCCGTTCTTAAACGTCGATCGAACGCGGCTCTGCTCAGTTCGCCAGAAAAACCCGGAAGAAAAACCAAAATCGT |
| | AACGACACCGAACTGTTCGATCGAACGCGGCTCTGCTCAGTTCGCCAGAAAAACCCGGAAGAAAAACCAAAATCGT |
| | TAAAAACTGTTCAACACCATCTCAACCAAATGGACCCTCTGAAAAACAACTCTAATACGACCTGCGCAGATCTACATCTCA |
| | GGAAGCGTTCAACACCATCTCAACCAAATGGACCCTCTGAAAAACAACTCTAATACGACCTGCGCAGATCTACATCTCA |
| | AGCGATGAAATCTGTAAACTGGCGAAAATCTGGTAAACTGGCGAAAATCGAAAAAAAGACAACTCTTTACAAATTCCCGGACTTCAT |
| | CGCGCTGTCTCAGATGAAATCTGCCTGCTGCTATCTCTGTCTATCTCTGTCGAAGGTCACTTCTGGAAGAAAAAATAC |
| | TACAAAATCTCTAAATTCCAGGAAAAAACCCAACTGGAACAGTTCTGGAACCGATCTTCCTGTACGAATTC |

TABLE 6-continued

SEQUENCE LISTING

| SEQ ID NO: | Sequence |
|---|---|
|  | AACTCTCTGTTCTCTGACAAATCAACACCAAAGACGGTGAAACCAAACAGGTTGGTTACTACCTGTTC<br>GCGAAAGACCTGCACAACCTGCACAACCTGTCTGACAGATGACATCCCGAAAGACTCTAAAGTTACCATC<br>AAAGACTTCCGCGACTCTGTTCTGACCATCTGACACCAGATGCGAAATACTTCGCCGTTGAAAAAAACGT<br>GCGTGGCTGGCGGAATACGAACTGGACTCTTTCTACACCCAGCCGGACACCGGTTACCTGCAGTTCTAC<br>GACAACGCGTACGAAGACATCGTTCAGGTTTACAACAAACTGCCTAACTACCTGGACAACGGTTGGGACAAACCGTAC<br>TCTGAAGACAAAAATGAAAACTGAACTTCGAAAACTGACCTACCCGGCGAACGGTTGGGACAAACAAGA<br>ATCTGACAACTGCGCGGTTATCTGCAGAAAGGTGTAAATACTACCTGGTCTGATCACCAAGGTCA<br>CAACAAAATCTTCGACGACCGTTTCCAGGAGAAAATTCATCGTTGGTATCGAAGGTGGTAAATACGAAAA<br>AATCGTTTACAAATTCTCCGTCCCTGAAGAAATCTCGCGTATCTACAACAACGCGGAATTCAAAAAGGTGAAACC<br>GAATTCTTCCGTCCGTCCGTGAAGAAATCTCGCGTATCTACAACAACGCGGAATTCAAAAAGGTGAAACC<br>TACTCTATCGACTCTTATGCAGAAATCTCTACAAAGACTCGACCAAAATACGAAGGTTGG<br>GCGTGCTACACCTTCCGTCACCTGAAACCGACCGAAGAATACCAGAACAACATCCGTGAATTCTTCCGT<br>GACGTTGCGGAAGACGGTTACCGTATGACTTCAGGGTATCTCTGACAGTACATCACGAAAAAAAC<br>GAAAAGGTGAACTGCACCTGTTCGAAATCTCACACAACAAGACTGGAACCTGGACAAAGCGCGTGACGG<br>TAAATCTAAAACCACCCAGAAAAACTGCACACCCTGTACTTCGAATCTCTGTTCTCTAACGACCAACGTT<br>GTTCAGAACTTCCCGATCAAACTGAACGGTCAGGCGGGAAATTCTTCACCCTCCGAAAACCGAAAAAGAC<br>AAACTGGAATCTAAAAAGACAAAAAGTAACAAAGTTATCGACCACCAAACGTTACTCTGAAACAA<br>AATCTTCTTCCACGTTCCGTGACCCTGAACCGTACCAAAAAACGACTCTTTACCGTTTCAACGCGCAGATC<br>AACAACTTCCGGCCGAACAACAAGACATCAACAATCATCGGTGTTTGACCGTGGTGAAAAACACCTGGTT<br>TACTACTCTGTTATCACCCAGGCGTCTGACATCCTGGAATCTGGTTCTCTGAACGAACTGAACCGTGTTA<br>ACTACGCGGAAAACTGGGTAAAAACGACCGGAAAAAGGTTACATCTCAGTTGTTCGTAAACTGGCGACTGGCGATC<br>CAGGGTATCAAAGACCTGAAAAAGGTTACATCTCAGTTGTTCGTAAACTGGCGGACTGGCGATC<br>AAACCAACGCGATCATCATCGTCGAAGACCGTGAAAACAGGCGTTTCAAACAGGTTCGTGTGGTATCGAA<br>AAATCTATCTACCAGCAGTGAAAAAGCCTGAACATGACAAACTGTCTTTCCTGTTGACAAAGTGAA<br>AAAAACCCGAACAGGCGGTCACCTGCTAGAAAGCGTACCCAGCAGTCTCTGCCGCCCAGTCTAAATCTTCCAG<br>AAATGGGTAAACAGACCGGTATCCGTTACTACAACAGCGTCGAAAAAGGAAACGACATCGCGAAAT<br>CCGGTTGGACTTCTACCGACCGGTTGTAACGACCGTTTCGACTGACCATCACCGAAAGACTTCCAGCAGGCGA<br>TCACCAAAATCGAATTCGTTAACGACCGTTTCGACTGACCATCACCGAAAGACTTCCAGCAGGCGA<br>AAGAATACCCGAACAAAACGTTTGGAAAGTTGCTCTAACCCTACACAAATCACCGAAAACATCCAGGAACTGTTCACCA<br>TGAACCAGAACAAAGGTGGTTACACCCATGACTGCGAACGTGCGATCGCAAAAACAGAACACCTT<br>AATACGGTATCGAATTCGATCACTTCTACTTCAACCTGATCTGCCAGATCATCCGTAACACCGAGACTCTGAAATC<br>CTTTCTTCCGTGACTTCATCTTCTACTTCAACCTGATCTGCCAGATCATCCGTAACACCGAGACTCTGAAATC<br>GCGAAAAAAACGGTAAAAATGCCGGAAAACGTGACGACAACCGGGTGCGTACAACATCGCGCGTAAAGGTATCGT<br>AACGGTAACAAACTGCGGAAATCTCTCAGTACTCGGAAATCATCCTCGGTTGAAACCGGTTCTCGACTCTCGTAAAGAC<br>TATCCTGAACAAAATCTCCAGTACTCCGGAAATCATCCTCGGTTGAAACCGGTTCTCGACTCTCGTAAAGAC<br>GTACGTTTCTAACATCGACTGGACAACTCGTTGAAATCATCCTTAGCGAAAGCTAAGGATGATTTTTTTA<br>TCTGAAATGTAGGGAGACCCTCAGGTTAACATATTCACTCAGGAAGTTATTACTCAGGAAGCAAAGAGGA<br>TTACA |
| SEQ ID NO: 71 | AATCAGGAGAGCGTTTTCAATCTCACCTCTGGCGCAGTTGATATGTCAAACAGGTTGCCGTCACTCGTC<br>TTTTACTGGCTCTTCTCGCTAACCAAACCGGTACCCGCTTATTCAAGTGTCAAAAGCATTCGGGA<br>CCAAAGCCATGACAAAACGCGTAACAAACGTCTATAATCACGGCAGAAAAGTTCCACATTGATTATT<br>TGCACGGCCGTCACACTTGCTATGCCATAGCATTTTATCCATAAGATTAGCCGGATCGTACCTGACGCTT<br>TTTATCGCAACTCTCTACTGTTTCCATACCCGTTTTTTGGGCTAGCAGTATACGTAATACGACTCACTATAGGG<br>GTCTCATCTCGTGTGAGATAGGCGGAGATAGAACTTCACCGGTCTGTACCCCGATCCTCAAAAACCCTGCGTTTCGAACTGATCC<br>CACCATAAACAAATTCGAAAATCGAAAACATCGAAAAATCTGAAATCCTGAAAACGACAACTACCGTGCGAA<br>CGCAGGGTAAAACCTGAATAACATCGAAAATGAAATTCACCAAATGTTCATCAACGAAACCTGACGAC<br>CTGCCATCAACTGTCTGAACTGAAAGTTGCCGTGAAAAACAACCGTATCGAAAATCGACGCGTCT |

TABLE 6-continued

SEQUENCE LISTING

SEQ ID NO: Sequence

AAAAAGAACTGCAGCGTGTTCAGAAAATCAAACGTGAAGAAATCTACAACGCGTTCATCGAACACGA
AGCGTTCCAGTACCTGTTCAAAGAAAACCTGCTGTCTGACCTGCTGCCAGATCGAACAGTCTGA
AGACCTGGACGCGGAAAAAAAACAGGGCGGTTGAAACCTTCAACGTTTCTCACCTACTTCACCGG
TTTCCACGAAAACCTAAAAACATCTACTCTAAAGAAGTATCTCTACCTCCTGTTACCTACCGTATCGTT
CACGACAACTTCCCGAAATTCCTGACAAACATGAAAGTTTTCGAAATCCTGCGTAACGAATGCCGGAA
GTTATCTCTGACACCGCGAACGAACTGGCGCCGTTCATCGACGGTGTTCATCGAAGACATCTTCCTGA
TCGACTTCTTCAACTCTACCTTCTCAGAACGGTATTGACTACTACCAACGTATCCTGGGTGGTGTTACC
ACCGAAACCGTGAAAAAATACCGTGTATCAACGAATTCACCAACCTGTACCGTCAGCAGCCCGGAA
TTCGGTAAATCTAAAAAAGCGACCAAATGTTGTTCTGTTCAAACAGATCCTGTCTGACCGTGACACCC
TGTCTTTCATCCCGGAAATGTTCGGTAAGACAAACAGGTTCAGAACTTCAGCTGTTCTACAACCG
TGAAATCTCCAGTTCGAAAACGAAGGTGTTAAAACGACGTTGCACCGCGTGGCGACCCTGACCTC
TAAAATCGCCGAGTTCGACACCGAAAAAATCTACATCCAGCAGCCCGGAACTGCCGAACGTTTCTCAGCG
TCTGTTCGGTTCTTGGAACGAACTGAACGCGTGCCGTGTTCAAATACGCGGAACTGAAATTCGGTACCGCG
GAAAAGTGCGAACCGTAAAAAAATCGACTAAATGTCGACCTGTTCTTCTTTTCACCGAACTG
AACAAGCGCTGGAATTCTCTGGTAAAGACGAACGTATCGAAAACTACTTCTCTGAAACCGGTATCTTC
GCGCAGCTGGTTAAAAACCGGTTTCGACGAAGCGCAGTCTATCCTCGAAACGAATACACCTCTGAAGTT
CACCTGAAAGACCAGCAGCCAGACCTGAAATCTGAAAATCAAAACCTTCCTGACGCGCTCAGAACCTGAT
GCACCTGCTGAAATCTCTGTGCGTTTCTGAAGAGCGGACCCGTGACGCGCCGGCGTTCTACACGAATTCGA
CATGCTGTACAACCAGTCGAAACTGGTTGTTCCGCTGTACAACAAAGTTCGTAACTACATCACCCAGAA
ACTGTTCCGTTCGACAAATCTGACAAATCAAAATCTACTTCCGAAAACAAAGGTCAGTTCCTGGGTGTTGGGTTGAC
TCTCAGACCGAAAACTCTGACAACCGTACCTGGGTATCTGCTCTGACCCGAAAACTGTTCCGTCTACCATCGTTTCTG
AAACGACCGTTCTCTTTCTGAACCGTCTTACCAGCTGACTCAAAAACCGCGTCTGTTTTACGGTAACTC
TTACTGCGGTAAACACCCGTACACCGGTGACAAAAAATGCGAAGACAAAGAGACTGGTTAACTCTATCGACCGTTTCGTTCA
CCTGTCTGGTAACACATCCTGAAACTCGATCGAAAAAATCGCGAAGACGTAAGAGCGCCGAACACCTACGAATGCGTCTGCTGCAGGA
CGAAAACTTCGTTTCTGAACCAGCCGTGTTCTGCGAAAAAAGACTACCACCTGTTCTGAAATCATCAACGACATCGAC
GTTCCGAAAGCCTGGTTTACGCCGAAAAAGCGTTCTTCTACTTCCCGGTTCTCAAAATCTCTAAACGACCTGTCTTCGGCGGAAAACTCTTCTAACC
GAACTGTCTTACGAAAAAGCGCTGCTGCTGTTCAAAATCTCTTACCTCCCGGTTTCAAAGACCTGTCTTTTGAACCACTTCGAAAAT
GTACCATCAAACCGCTGCTGTTCAAAAAATCTAAACAAAAAACCTGCACACCCTGTACTTCGAAGCGCTGATGAAAGGTA
AGTTAACCGTCAGAAAATCGGTAAAGAAATCGGTTAAAATGTTTTCCAACGTGTTAAATCTCTGAACTACACGAAA
ACCAGACGCACCATCGACATCGGTACGGTATGGTTTTCACCCTGTTAAATCTTACCCGATCATCAAAGACA
AACCCTGAAATACGGCTGACAAATTCTCTGTTCCACCTGTCTACCAGCTGACAACTACAAAGAAAACGTAAAC
AACGTTTCGCGTCTGACAACCTCTATCATCGAAATTCCGACAACCCGGACATCAACATCGGTGACCGTG
CGCTGAACAACTCTATCATCGATCTACTGACGAATTCGATCGAGAAATGCTGATGCACAAATGAACTGAACTAC
GTGAACGTCACCTGATCACCTACACTACCAGAGAAGGTGAAATCTGCCGTCAGAAAACCTTCA
ACATCGTTGGTAACAACCAACTACCACCACCAGCGTGAACCAGCGTGAAAAAGAACCTGAACAAGCGCGT
AATCTGGGCGACCATCGGTAAAATCGGTAAAATCAAAGAACTGAAAGAAGTTTCCTGTCTGGTTATCCAGAA
ATCGCGAAAATCATGGTTGAAAATCAACACGCGATCGTTGTTCGGAAGAACTGGACTTCTGAACGT
GGTCTGTCTCGATGAAAATCTACCAGAAATCGCAAAAAATGCTGATCGACAAAATCGAACTGAACGAA
CGAAAAATTCAAAACAACTGTAACAAATCTCTTTCAGACCGCCAAACAAAATGGACATCTGCACCGTTGTGAAAAAACTG
CGTTTCACCTACACTGCGAACGTTTAAATCGTTAACGATGCGTTAACCTGTTAACGTTACCGACAGCCAAA
ATTCGAATCTTTCCAGAAATGGGTAAAGTCGGTTCGTTAACATGCTGAACCTGAACGACTACACCAACCAACATGAAGAGCGGAC
ACCCTGCTCTGTATGGATGGATGCAAAATCTCTTTCAACGCGCAAATCGATGGCAACAACTGAACTAC
CGAAAAAATTCAAAACCAACCAGACCGACCAAAGAACCACCACACCGTTAACCGCATCGACGACGCATTGTTGAAAAAACTG
CTGAAATTCTCGAAATCGGTGCTGTCCGGCGTGAAAACATGCAGATGCGTAACTCTAACCACCAAA
ACGAAGAAGACTTCATCCTGTCTCCGGTTAAAACTCTTAACGGTAAACTTCTTCCGTTCTAACGACGACG

TABLE 6-continued

SEQUENCE LISTING

| SEQ ID NO: | Sequence |
|---|---|
| | CGAACGGTATCTCGGCCGGCGGACGCGGACGCGGACGGTCGTACCACATCGCGTGAAAGGTCTGTACC |
| | TGGTTAAAGAATGCTTCAACAAAAACGAAAAATCTGAAAATGAACACAAAACTGTTCAAATTCG |
| | CGCAGACCCGTTTCAACGGTTCTCTGACCACAAAACGGTTAAGAAATCATCTTAGCGAAAGCTAAGGAT |
| | TTTTTATCTGAAATGTAGGGAGACCCCTCAGGTTAAATATTCACTCAGGAAGTTATTACTCAGGAAGCA |
| | AAGAGGATTACA |
| SEQ ID NO: 72 | AATCAGGAGAGCGTTTTCAATCTTACCTCTGGCGCAGTTGATATGTCAAACAGGTTGCCGCTCACTGCGTC |
| | TTTTACTGGCTCTTCTCGCTAACCAAAACCGGTAACCCCGCTTATTAAAAGCATTCTGTAACAAGCGGGA |
| | CCAAAGCCATGACAAAACGCGTAACAAAAGTGTCTATAATCACGGCAGAAAAGTCCATTGATTATT |
| | TGCACGGCGTCACACTTTGCTATGCCATAGCATTTTATCCATAAGATTAGCGATCCTACCTGACGCTT |
| | TTTATCGCAACTCTCTACTGTTCTCCATATCCGTTTTTTGGCTAGCAGTAATACGACTCACTATAGGG |
| | GTCTCATCTCGTGTGAGATAGGCGGAGATACGAACTTTAAGAGAGGAGATATACCATGCACCATCATCAT |
| | CACCATACCCAGTTCGAAGGTTTCACCAACCCTGTACCAGGTTTCTAAAACCCTGCGTTTCGAACTGATCC |
| | CGCAGGGTAAAACCTGAAAACATCTCAGGAACAGGGTTTCATCGAAGAAGACAAAGCGCGTAACGAC |
| | CACTACAAAGAACTGAAAACCGATCATGACCGTATCTACAAAACCTGAACCAGTGCCTGCAGCTG |
| | GTTCAGCTGGACTGGGAAAAACCTGTCTGCGCGACCTACCGCGATCGACTCTTACCGTAAAGAAAAACCGAAGAAACC |
| | CGTAACGCGCTGAATCGAAGAACAGGCGACCTAACGCGATCACCGACTACTTCATCGGTCGTACC |
| | GACAACCTGACCGACGCGATCAACAACGTCACGCGGAAATCTACAACAAGGTCTGTTCAAAGCGAACT |
| | GTTCAACGGTAAAGTTCTGAAAACAGCTGGGTACCGTTACCACCACCGAACACGAAAAACGCGCTGCGCG |
| | TTCTTTTCGACAAATTCACCACCTACTTCTCTGGTTTCTCAGGACAACCTTCTACGAACAACCGTAAAACCGTTTTCTCTGCGGAA |
| | GACATCTCTACCGCGATCCCGCCACCGTATCGTTCGGCGTCTCGTCTGCCGTGAACACTTCGAAAACGTTAAAAAGCGATCG |
| | ATCTTCACCCGTCTGATCACCCGCCGATCTTTATCGAAGAAGTTTTCTCTTTCCCCGTTCTACAACCAGCTGCTGACCCAGACC |
| | GTATCTTCGTTTCTACCCTCTATCGAAGAAGTTTTTCTCTTTCCCGTTCTACAACCAGCTGCTGACCCAGACC |
| | CAGATCGACCTGTACAACCAGCTGCTGTGGGTGTATCTCTGTGAAGCGGGTACCGGAACCCGGCAGTAACCCGAAAAAATCAAAGGT |
| | CTGAACGAAGTTCTGAACCTGGCGATCCGGATCCAGATCTGTCTGACCGTAACACCTGTCTTTCATCCTGCCG |
| | TCAAATCTGACGAAGAAGTTATCCAGTCTTTCTGCAAATAACAAAACCCTGCGGTAACGAAAAACGTTCT |
| | GGAAACCGCGGAAGCGTGTTCAACGAACTGAACCTATGACCTATGACCGACCCACCATCTTTCATCTCTCACAA |
| | AAAACTGGAAACCATCTCTTCTGCCGCCGTGCGAACACTGGGACACCCTGCGTAACGCGCTGTACGAACG |
| | TCGTATCTCTGAACTGACCGGTAAATCACCAAATCTGCCGGGCGCGAGAAAAAGTTCAGCGTTCTCTGAAACA |
| | CGAAGACATCAACCTGCAATCTGACCGGGCGCCACCGAATTCATCCTGCGCGCAACGAGCCCGGACCACCCCTGAAAAAACA |
| | AACCCTCGAAATCTGTCTCACGACCGCCGCCGGTCCTGGTCTCCGACCCTGAACCAAAAATCTGTTGAAAA |
| | GGAAGACATCAAACGAAAATCCTGAATCTGAAATTCAGCTGGACTTCAGCGTTCTGTACCACCTGCTGGTT |
| | CGCGGTTGACGAATCGAATCTAAGAAGTTGACCGGAATTCTCTGCCGTCTGACCGGTATCAAACTGGAAAT |
| | GGAACCGTCTCGTCTTTCCAGATGCCCACCTGGCGTCTGGTTGGGAGTTAACAAAGAAAAAACACGG |
| | ATTCAAACTGAACTTCCAGATCCGTCTGCTGTACACCTGGGTATCATGCCGAAACAGAAAGGTCGTTACAA |
| | TGCGGATCCTGTCTTTCGAACCGGACTGGCGAAAATGCTCAAACGCTGAAGGTTTCACAAATGGGTTACCGCCACTTCCC |
| | AGCCGTCTCTTTCCCAGATGCGCTAACACTTCCAGCTGGAATCTGGAAATGTTAACAAAGAAAAAACACGG |
| | GGAACCGTCTCTGTCTTTCGAACCGGACTGGCGAAAATGCTCAAACGCTGAAGGTTTCACAAATGGGTTACCGCCACTTCCC |
| | CACCAGCCCCGATCCTGCTGCTAACACTCTGTTCATCGAACGTGGAAATCAACAAAGAAATCTACGACCT |
| | GAACAACCCGGAAGAACAGAAAAACCGAAAAAATTCCAGACGCACTTCACCGTGACTTCCCTGTCTAAATACACCAAAAACC |
| | GGTTACCGTGAAGCGCTGTGCAATGGATCGACTTCACCGTCTTCCGTCTCAGTACAAAACGGAATACTACGCGGAAC |
| | ACCTCTATCGACCTGTTCTACCAACATCTCTTTCAGATCTACAACAAAAGAATCATGACGCGGTTGAAA |
| | CCGGTAAACTGTACCTGTTTCAGATCACAAACAAAGACTTCGCGAAAGGTCACCACGGTAAACCGAACC |
| | TGCACACCCTGTACTGGACCGGTCTGTTCTCCCGGAAAATCTGGCGAAAACCTGGCGAAAAACCTCTATCAAACTGAACG |
| | TCAGGCGGAACTGTTCTACCGTCACCAGAAACCCCGATCCCGGAATGAAACGTATGCCGACCCCTGTACCAGGAACTGTACGAC |
| | TGCTGAACAAAAACTGAAAGAACCAGAAAACCGGATCTGACCGCGAAAAATCGTATACCGCTACAAAA |
| | TACGTTAACCACCGTGTCTCACCACCCTGTCTGACGAGGCCGCGGCCGCTGCCGAAGCTCTGCCGAGCTATCACCA |

TABLE 6-continued

SEQUENCE LISTING

| SEQ ID NO: | Sequence |
|---|---|
| | AAGAAGTTCTCACGAAATCATCAAAGACCGTCGTTTCACCTCTGACAAATTCTTCTTCCACGTTCCGAT<br>CACCCTGAACTACCAGGCCGCGAACTCTCCGTCTAAATTCAACCAGCGTGTTAACGCGTACCTGAAAGA<br>ACACCCGGAAACCATCAAAACCCGATCATCGGTATCGACCGTGACGTAACCTACCTGATCATCACCGTATCGA<br>CTCTACCGGTAAATCCTGGAACAGCGTTCTCTGAACACCATCCAGCAGTTCGACTACCAGAAAAAACT<br>GGACAACCGTGAAAAGACGTGTTGCGGCGCTCAGGCGGTGGTCTGTTGTTGGTACCATCAAAGACCT<br>GAAACAGGGTACCTGTCTGAAATCGGTTTCACCACGAAATCGTTGACCTGATGATCCACCAGGCCGTTGTT<br>GTTCTGGAAAACCTGAACTTCGGTTTCAAACTGCCTGATCGACGAAAAGCGGTTTACCAG<br>CAGTTCGAAAAAATGCTGATCGACAAACTGAACTGCCTGGTTCTGAAAGACTACCCGGCGAAAAAGTT<br>GGTGGTGTTCTGAACCCGTACCAGCTGACCGACCAGTTCACCTCTTTCGGCAAAATGGGTACCCAGTCTG<br>GTTTCCTGTTCTACGTTCCGGCCGTACACCGTCTAAAATCGACCCGTTGACCCGTTTCGTTGACCCGTTC<br>GTTTGGAAAACCATCAAAAACTCCGTATAAAACACTTCTGGAAGTTTCGACTTCCTGCACTACG<br>ACGTTAAAACCGGTGACTTCATCCTGCACTTCAAAATGAACCGTAACCTGTCTTTCCAGCGTGGTCTGCC<br>GGGTTTCATGCCGGGTAAACGTATCGTTCCGGTTATCGAAAACGAAACCACCGTTTCACCGGTCGTGACCTG<br>TACCCGGCGAACGAACTGATCGCGTCTGCGAACCACCTGAACAAGGTATCGTTTCCGACGGTTCTAACATC<br>CTGCCGAAACTGCTGGAAAACGACGACTCTCACGCGATCAGACACCATCAGCAACTCTCCGTTCGTTCTGTTC<br>TGCAGATGCGTAACTCTAACGCGGCAACCGGAATGGCCGATGACGCGAACGGTGCCTACC<br>GTGTTTGCTTCGACTCTCGTTTCCAGAACCGGATGCGATCAGAAGAATCTAAAGACCTGAAACTGCAGAACG<br>ACATCGCGTGAAAGGTCAGCTGCTGCGAACCACCTGAAGAAATCTAAAGACCTGAAACTGCAGAACG<br>GTATCTCTAACCAGGACTGCCTGGCTGAAATGTAGGGAGACCCTCAGTTAACTACTAGAAATATTCACTCAGGAAGTTATTACTC<br>AGGAAGCAAAGAGGATTACA |
| SEQ ID NO: 73 | AATCAGGAGAGCGTTTCAATCCTACCTCTGGCGCAGTTGATATGTCAAACAGGTTGCCTCACTGCGTC<br>TTTTACTGGCTCTTCTCGCTAAACAAAACCGTAACCCGTACCCCGCTTATTATCACGGCAGAAAGCATTCTGTAACAAGCGGGA<br>CCAAAGCCATGACAAAACCGTAACAAACCGTATATATCACGGCAGAAAAGTCCACATTGATTATT<br>TGCACGGCGTCACACTTCTCATACACTTGCTAATCAGCATTTAATCCATAAGATTAGCGATCCTACCTGACGCTT<br>TTTATCCAACTCTCTACTGTTCTCCATACCCGTTTTTTGGGCTAGCAGTAATACGACTCACTATAGGG<br>GTCTCATCTCGTGTGAGATAGGCGGAGATAAGTTAAACTGCCTGTCTGACGACATGCCGGAAATCCGTGCGGGTCTG<br>CACCATGCGGTAAAACGTTATCATCAAAGTTAACCGGGTTGTTCGTTACTACCACCCGGATGCTCTCTGCCCTCAG<br>GAAAACCTGTACCGTGTCTTCTCGAACGGTGACCAGGAATGCCGACAAAACCGCGAAGAAATG<br>CAAAGCGAACTGCTGGAACGTCTCGCGCGTCAGGTTGAAACACGTCACCGTCCGGCGGTTC<br>TGACGACGAACTGCTGTCTCCAGCAGCGTCAGCTGTACGAACTGCTGGTTCCCAGGCGATCGGTTGCGAA<br>AGTTGACGCGCCAGCAGATCCGGTAACAAACCGTTGGGTTCGTAGCGAAGCGGGTGAACCGGGTTGGG<br>AAGAAGAAAAGAAAAAGCGAAACCGTAAATCTGCGACCGTACCGGACCGGACGTTCTGCGCCTGCCCTG<br>GCGACTTCGGTCTGAAACGCTCATGCGTGATGCGTTTTACACCGACTCTGAAATGTCTTCTGTTGAATGGAAAC<br>CGCTGCGTAAAGGTCAGGCCGTTCGACCGTACCGACGTCGAAACCGGGACATGCAGCCGGAATGCAGAAAAACCGTT<br>TGTCTGGGAATCTTGGAACCAGGTCGGTTGGTGCAGGAATACGGAAATCGTTCAGCAGAAAACCGTT<br>TCGAACAGAAAACTTCGTTGGTCAGGAATCTGGTTCACCTGGTTAACGCGCCACTACGGTCAGCAGGACATGA<br>AAGAAGCGTCTCCGGGTTCGGAATCTGAAATCTAAAGAACAGACCGGCGCGTTCGACCTTGTCGCGTGACCGGG<br>AAATCAAAAACGTTGACCGTGTAACAACCGGTCGTTTCGGTTTCCACTTGTTCGCGAAACTGGCGG<br>AACCGGAATACCAGCGCGCTGGTGCGTGAAGACGCGTCTTTCCTGACCGTACGGGTTTACAACTCTAT<br>CCTGCGTAAACTGAACCACGCAGAAATGTTCGCAGCCTTCCAGACCTTCACCGTGACCGCGACCCCGAT<br>GGGACCCGGTTCGACAACGTTGGGTAGCTGCACCAGTACACCTTCTGGAACGGTTGCCGCTGAAGTTGACGAC<br>CGTCACGCAGGTCGATCCTTCTCCACAAACTGCTGAAAGTTGAAAACGGTGTTGCCCGTGAAGTTGACGAC<br>GTTACCGTTCCGATCTCTATGTCTGAAACAGCTGGACAACCTGCTGCCGCTGACCCGAACGAACCGATCG |

TABLE 6-continued

SEQUENCE LISTING

| SEQ ID NO: | Sequence |
|---|---|
| | CGCTGTACTTCCGTGACTACGGTGCGGAACAGCACTTCACCGGTGTGAATTCGGTGTGTGCGAAAATCCAGT |
| | GCCGTCCGTGACCAGCTGGGCGCACATGCAGCCGTCGTCGTGCCGCTGGTGCCGCTGACGTTTACCTGAACGTTTCTGT |
| | TCGTGTTCAGTCTGTCAGTTCGACATGGCCGTGTGAACGTCGTCCGCCGTGACCGCGGTTTTCCGTCTGGTT |
| | GGTGACAACCACCGTGCGTTCGTTCACTTCGACAAACTGTCTGACTACCTGGCCGGAACACCCGACGAC |
| | GGTAAACTGGGTTCTGCTGCTGTGAAGGTCTGCTGGTCTGCGTGTTATGTCTGTTGACCTGGGTCTGCCTACCT |
| | CTGCCTCTATCTCTGTTTTCCGTGGCGCATAAGGTAACGACCTGGTTGCGCCGAACTTCAAGGTCGTGTTCC |
| | GTTCTTCTCCGATCAAAGGTAAGCACCTGCCTGCCGCCGTGCCGGTTCACGAACGTTCTCAGCTGCTGAAACTG |
| | CCGGGTGAAACCGAATCTAAAGACCTGGGCTTCGTCTGCTGCTGCCTGTTGCTTCGTTGAAGACGTTGTCGTGAACGTT |
| | CGTACCCAGCTGGCGAAACTGATCGAACAGCCGGTTGACGCGGCGAACCACATGACCCCGACCTGGCGTGAAGCGT |
| | CTTGGGCGAAACTGGCAAACTGTGAACTCTCGCACGGTATCTCTGACATGGATGACGCGG |
| | TCGAAAACGAACTGAACTCGAGAAATCTGAAATCTGCCGTTCGTGGTAACTCTATCGAACAGAT |
| | TTTACGAATCTGTTCTGCTGTTTGGCGTCACATGGGTAAACAGGTTCGTGACTGGCGTAAAGACGTTCG |
| | TTCTGTGAACGTCCGAAATCTGGTTACGGCGAAAGACGTTGTTGGTGTAACTCTATCGAACAGAT |
| | CGAATACCTGGAACGTCAGTACAAATTCCTGAAATCTGGCTCTTTCTGGTGTAAAGTTTCTGGTCAGGT |
| | ATCCGTGCGGAAAAGGTTCTGTTTCGCCGATCACCCTGCGTGAACAACATGACCACGCGAAAGAAGAC |
| | CGTCTGAAAAAACTGGCGGACCTGTATCATGGAAGCGCTGGGTTACCGTGGGTCTGACGAACGT |
| | GGTAAGGTAAATGGGTTGCGAAATACCCGCCGTGCCAGCTGACTCCGTGAAGACGTCTGCTGGTGTTTCC |
| | CAGTTCAACAACGACCGTCCGCCTCGAAAAACAACCAGCTGCAGTGGTCTCACCGGTGGTGTTTCC |
| | AGGAACTGATCAACCAGGCGCCAGGTTCACGACCTGTGGTTGGTATACCATGTAACGCGGCCGTTCTCTTCTCG |
| | TTTCACGCGCGTAACCGGTGCGCCGGTATCCGTTCCGTGTGTTCCGGCCGTTGCACCAGAACAC |
| | AACCCGGAACCGTCCGGTCCGGTGCTGACCGGTGAAGGTGAAATTCGTTGTTCCGTCTGTCGGAAGGT |
| | CGTGCGGAGACCTGATCCGACGGTGAAGGTGAAATCTGAAATCTGCCAGCAGACCTGCAGCCGTCGTGACTTC |
| | GACATCTCCAGATCCGTCCGTCTGCGTTGTGGACTCCTACTCAACAAGTTTTCTACACCGGTGTTACTCCGGC |
| | TGACCGGTAAACGTACCCGCGGACGCTCTTACCCTGAAGTCGTGAACAACTGTCGAAGAAGCGG |
| | CGAACGTGAACGTGTGAAGCGGACGACCGTGAAAAACAACGCTGTAAGTTTCGCCAGGAAACACTGTCGACCCGTCTGGTATCA |
| | TCAACGTGTAACTGGACCCGTGCAGATTTGGTCTATGTTAACAGCGTATCGAAGGTTACC |
| | TGGTTAAACAGATCCGTTCTGCTTTGTCCCGTCGAGGATTTTTTATCTGAAATGTAGGAGACCCCTCAGTTAAATATTC |
| | ACTCAGGAAGTTATTACTCAGGAAGCAAAGAGGATTACA |
| SEQ ID NO: 74 | AATCAGGAGAGCGTTTTCAATCCTACCTCTGGCGCAGTTGATATGTCAAACAGGTTGCCGTCACTGCGTC |
| | TTTTACTGGCTCTTCTCGTAACAAAACCGGTAACGCCGTACCCGCTTATTAAAAGCATTCGTAACAAAGCGGGA |
| | CCAAAGCCATGACAACAAAAAACCGTAACAAAACGCTCATATACACCGCAGAAAAGTCCACATTGATTATT |
| | TGCACGGCGTCACACTCTATGCCATAGACATTTTATCCATAAGATTAGCGGATCTTACCTGACGCTT |
| | TTTATCGCAACTCTCTACTGTTTCTCCATACCCGTTTTTGGGCTAGCAGTAATACGACTCACTATAGGG |
| | GTCTCATCTCGTGTGAGATAGCGGAGATACGAACTTTAAGAGGAGATATACCATGCACCACCATCAT |
| | CACCATGGACACCCGTTCTTTCATCGAAGATCTGCTACTACATGAAATCGAAAACCTGTCTCAGGAAGCG |
| | ATCTACGAACACCACAGGACCCGAAAAACCGAAAAACTTTCTAAAGCCGAAATCCAGCGGA |
| | ACTGTGGGACTTCGTTCTGCGTGAAAATGCAGAAATGCAACTCTTTCCGTCTTCTGTTGAAAAAAAGGTGAAGCGAAC |
| | TTCAACATCCTGCCGTGAAATTCCTGTACCCGGTCTGACCATGATTAGCGGATCTTCAGTCTGGTAAAGGTACCCGCTCTT |
| | CTGGTCTAACAACCGCGTTGGATACAACCTGGATAAATCGGGTGACCCGTCTGGGAAGAAGAAAAAAA |
| | AAATGGGAAGAAGACCAAAAAAAGACCCTGCGCAAATCTGCGAAATGGCGAATCTGGCGAATACGGTCT |
| | GATCCGCTGGTTCCATCCCGTTCATCCCGTTTCACCGACTCGAAGAAGCGTTCATCCAGGCGTTAAGGCGTTAAGGCGTTTCCTGTCT |
| | TGGGAATCTTGGAACCTTGAAGTTAAAGAAGAATACGAAAAAGTGAAAAGTTGAAACGTTTCCTGTCTGGA |

TABLE 6-continued

SEQUENCE LISTING

| SEQ ID NO: | Sequence |
|---|---|
| | AGAACGTATCAAAGAAGACATTCAGGCGTTCAAATCTCTGGAACAGTAGACGAAAAGAACGTCAGGAAC
AGCTGCTGCGTGACCCCTGAACACCAAGCGAATACCGGTCGTCTAAACGTGGTCTGCGTGGTTGGCGTG
AAATCATCCAGAAATGGCTGAAAATGGACGAAAACGAACCGTCTGAAAAATACCTGGAAGTTTTCAAA
GACTACCAGCGTAAACACCCCGCGTGAAGCGGGTGACTACTTCCGTCTGTTTACGAATTCCTGCTAAAAAGAA
AACCACTTCATCTGCGTAACCACCCGAATACCGTACCTGTACCGGCGACCTTCTGCGAAATCGACAAA
AAAAAAAGACGCGAAACAGCAGGCGACCTTCACCGTGACCGTATCCTGACGACAGCTGCACCGA
TCGTTTCGAAGAACTTCTGGTTCTAACCTGACAAATACCGTATCCTGATCTTCGACCAGTCGCACCGA
AAAACTGAAAAAAAAACTGACATCGTTCTGCTGCCGTTCAGCTGGACCGTCGATCCTGATCTTCCTGACATC
AGAAAAGGTAAAGTTGACATCGTTCTGCTGCCGTCTCGTCTGCCCGTTCAGTCTACAACCAGATCTTCCTGACATC
GAAGAAAAGGTAAACACGGCGTTACCACCTACAAAGACGAATCTATCAAAATTCCCGCTGAAAGGTACCCTG
GGTGGTGCGCCGTGTTCAGTTCGACCGTCGTGCGCTGCCGTTACCCGCACAAAGTTGAATCTGTAACG
TTGGTCGTATCTACTTCAACATGACGTTAACATGCGAACCGACCGAATCTCCGGTTTCTAAATCTGAA
AATCCACCGTGACGACTTCCCGAAATTCGTTAACTTCAAACCGAAAGAACTGACCGAATGATCAAAGA
CTCTAAAGGTAAAAAACTGGTATCGAAATCTGGAAATCTGGAAATCGGTCGTGTTATGTCTATCGAC
CTGGGTCAGCGTCAGGCGGCGGCGGTCTATCTTCGAAGTTGTGACCAGAAACCGGACATCGAAGGT
AAACTGTTCTTCCCGATCAAAGGGTACCGAACTGAAGTTCTGCGTAAAGCGCGTCAGTTGAAGAACATCACCGAACGTGAAGAAA
CGGGGTGAAACCCTGGTTAAATCTGTGAAGTCTGCGCTAACCTTCAGCAGTTCGAGAGCATCACCGAACGTGATGA
ACCAGAACTGAACTTCTACCAAATGGATCTCTCTCAGGAAAACTCTGACGTTCCGTGTTTTACCAGACGAACTGAT
CCAGATCCGTGAACTGATGTACAAACCGTACAAACACTGGGTTGCGTTAAATCCGTCTGACGGTCGTAAGGTCT
TCTGGAAGTTGAAATCGGTAAAGAAGTTAAAACATGCGACCGTAAATCGACCGTACCGTACCCGTAAATTCCTGCGTCTGCCTTGGTCTCTG
CGTCCGACCGAACCGGGTGAAGTTCGTCGTCTGGAAACCGGTTCTGCGAACCGGTCGATCGACCAGCTGAAC
CACCTGAACGCGCTGAAAGGAAGAACCGTCTGAAAGAAAATGCGAACAAACCCCGGCCGTGAAGGGTGAAATCG
TTACTGCTACGACGTTCGTAAAAAAAATGCGAGGCGAAGAACGTTCTGTTCGTTCGAAAAACTCTAAACTGATGAAATGGTCT
AGACCTGTCTAACTACAACCCGTACGAAGAACGGTTTCCAGGTCGATGAAAAACCGGTTCGAATGGTGAAGGTGCT
GGCGCAGTTCTCTTCTGCTGTTTCCACCGAAAACCGGTTCTGCAGGGTGAACGGTTGCGATCGACCAGCTGAAC
AAAAACTGCAGGACAACCGTTTCTTCAAAAACCTGCAGCCGTGAAGGTCGTCGTGACCCTGGACAAAATCG
CGGTTCGAAGAAGGTGACCGTACCCCCGGACACATCACGGGCGACAAAGGTGGTGAAATTCTCTTCGTAAGTT
GTAAACTGGTTACCAAGAGTTACTGCAAAGTTACGTGCAAGGTGACCAGGTTACACCCATCCCCGAAATC
CCCACGGTTTTCACAAAGTTTACTGCCAAGCGTACAAGGTGACCGTGACCGTTACATCCCGGAATC
TAAAGACCAGAACAGAAAATCATCGAAGAATTCGGTGAAGGTTACTTCATCCTGAAAGACGGTGTTTA
CGAATGGGGTAACGCGGGTAAACTGAAAATCAAAAACTGGTCTTCTAAACAGTCTTCTCTGAACTGGT
TGACTGCCATCCGTGTAACGTTTCGACCTGGTTGAACCGTTGAACATGGCGCGGTGTTTCTTCGGTAAACTG
CCGTACCCGTCTGATCTCTAAACTGACCAACCAGTACTCTATCTTACCATCGAAGACGACTCTTCTAAAC
GAACGTATCCTGATCTCTAAACATCCTAGCCGAAAGTAAGAGATTTTTTTTATCGAAATGAAAATGAGGAGACCCTCA
AGTCTATGTAAGAAAATCATCCTTAGCGAAAGCTAAGAGATTTTTTTTATCGAAATGAAATGAGGAGACCCTCA
GGTTAAATATTCACTTCAGGAAGTTATTACTTCAGGAAGCAAAGAGGATTACA |
| SEQ ID NO: 75 | AATCAGGAGAGCGTTTTCAATCCTACCTCTGGGCCGCAGTTGATATGTCAAACAGGTTGCCTCACTGCGTC
TTTTACTGGCTCTTCCTCGGTAACCAAACCGGTAACCGGTAACCCCGCTTATTAAAAGCATTCTGAACAAAGCGGGGA
CCAAAGCCATTGCAACAAACGGTAACAAACGGTCTATAATCACGGCAGAAAAGTCCACATTGATTATT
TGCACGGCGTCACACTTGCTATGCCATAGCATTTTATCATAGATCCGAATTCGTACCTGACGCTT
TTTATCGCAACTCTGTTTCTCATCCCGTTTTTGGGCTAGCAGTAATACGACTCACTATAGG
GTCTCATCTCGTGTGAGATAGCGGAGATAGGGAACTTTAAAGAGGAGATATAACCCATGACCAAACCGGACCCTGCT
CACCATCCGACCCGTACCATCCAACCATCAACCTGGTTCTGGGTAAAACCCGGAAAACGCGACCCGTGT
CGTGCGCTGTTCTCACCCGCTGGTTGACAACGGTAAAGGTAAGAGGCAAAGCGGAATTCCTGCTGT
GCCGTGGTGAAGGCTACCGTACCCGGTTGACAACGGTGGACAACGGTAAAGAGCGAAATCCCGCGTCACGCGGTTC |

TABLE 6-continued

SEQUENCE LISTING

| SEQ ID NO: | Sequence |
|---|---|
| | AGGAAGAAGCGCTGGCGTTCGCGAAAGCGCGCAGCGTCGAGCGTGCACAACGGTTGCATCTCTACCTACGAAGACC
AGGAAATCCTGGACGTTCTGCCTCAGCTGACAAGCGCTGTACGAACGTCGTTCCGTCTGTTTAACGAAAACACGAAG
CGGGTGACGCGCAGGCGGCGAACGCGTGGGTTTCTCCGCTGATGTCGCGAATCTGAAGGTGGTCTGT
CTGTTTACGACAAAGTTCTGGACCCGCCGGTTTGGATGAAACTGAAAGAGAAAAAGCGCGGGGTTCTC
GGGAAGCGGCCTCTCAGATCTGGATCCAGTCTGACGAAGGTCAGTCTCTGCTGACGACCTTCGTTTCTGACCAGAAA
CGCCCGTTGGATCCGTAAACTGCCTTCTGGTCAGCGTGGCAGGACGACTTCGTTTCTGACCAGAAAA
AAAACAGGACGAACTGACCAAAGTGACGCCCCTGATCAAACAGCTGAAAGAAATGGGTCTGCTG
CCGCTGGTTAACCCGTTCTTCCGTCACCTGCTGGACCTCATCTTTGGAGAATCTTGGAACCACCGTGTTTCTCCGTGGACCGTC
TGGCGGTTCGTGCGCGCGTTGCGCATTCGACGAATTCGAAGCGGCGTGGAACCACCCGTACCCGTGCGGAATA
CAACTTCTGAAACTGCCGTCGACGAATTCGAAGCGGCGTTGGAACCACCCGTACCCGTGCCGAATA
GCTCGCTACGAGCGAAACGTCACTCTACCCTGAAATCTATCGCCGTGGCGACGACTCTAACCC
GTACCGTATCGGTGTTCGTTCCTCGTGCGTGGAACCGTGTTCGTGGAAGATGATCGACAAAGGTGC
GACCGAAGAACAGCGTGTTACCATCCTGTCTAAACTGCAGACCCGAGCTGCGTGGTAAATTCGGTGACCC
GGACTGTTCAACTGGCTGGCGCAGGACGTCACGTTCACCTGTGGTCTCCGCGTGACTCTGTTACCCG
CTGGTTCGTATCAACGCGGTTGACAAAGTTCTGCGTGTGTAACCGCTGGATGACCTTCGCGC
ACCCGCGTTTCCACCCGCGTTGGATCTCGTACGAAGCGCCGGGTGTTCTTAACCTGCGTCAGTACGCGCT
GGACTGCACCGAAAACGCGCTGACATCACCCTGCCGTCTGGTGAACGACCTGAGACCTGGAAAACTGGA
CGAAAAAAAAAAAACCGTCTGTACTACCGTTCGTTTCAGCAGTTCGCGGTCTGGCGGTGGTGCGGA
AGTTCTGTTCCACCGTCCGTACATGGAACACGACGAACGTTCTGAAGAATCTCTGCTGGAACGTCCGGGT
GCGGTTTGGTTCAAACTGACCCTGCCGGAAGTTCACCACTTCAAAACGCCGTGTCTAACAAATCTAAACACCCGTA
CCCTGCAGCCGGGTCTGCGTGCTGTCTGTCTGTATCGCCGTCTGACCTTCGCGTCTTGCTCTGTTTTC
GAACTGATCGAAGGTAAACGAAACCGGTCGTGCGTTCCCGGTTGCGGACGAACGTTCTATGGACTCT
CCGAACAAACTGTGGGCGAAACACGAACGTTCTATCGCGCTGGAAAATCTACGCGTGAAACCGCAGCGTCT
AAAGAAGAAGAAGACGTTTATCGCGTCGTGAAGAAGAACAACGAAACGTTCACCGGCTCTGGAACAGTTCTTC
AAATCTGCTGCGTGGTAAGAGACGTTGTTCCGGTGCGCTCAGCGCTGCCTGCGCCAGGCTACCAGGACCTGTCCCGCGTTCGCGTGGAACCAGTTCTTC
AAAGGTTGGGGTGCAGAAGACGTTGTTTCCGGTGCGCTCAGCGCTGCCTGCGCCCAGGCGCCGTGCCTGTCAGGGTCGGGT
GCGGCGCCGTTCGTTCACCCCGGAACTGTGGCGTCAGCACTGCCAGACCCGACCTGCCAGACCTCTGCAAGCGGAA
GGTACAAAACCCGTTCTTACCACGGTGGAAACATTCTGACTGGCGTAATCTATCTGGATGGAATAACCGCTGAAAATGT
AACTCCTCTGTCTGTCTTGGTCCTCGCGTCTACCTACGCCTGCGATCAACCGTCAGGACACCGCGGTTCGTT
CGGTTCTCCGGCGTTCTCGGCTCTCCCACCATCACCGCTGCCGCACGGGTTACAGCGTAAAGGTTGGAACAGCTTAC
GACTTCATCTTCAGGCGGCGCGTGGTTACATCCGCGCCTGGACTTCGTTCCGCGTTACCCGTTTCCGCCCCGTCGTG
GAACCGTGCCAGCTGATCGTGATGCGATCGTGCGATCGGGCGACACCGCGAAACCACCATGCAGCGGAACTGT
AAAACTCTCAGCTGATCGAAGAAAACACCGGCGGGTTTCTTCTTCTCTGTTTCCACCGACCGTGCCCG
ACGGTCAGATCGTTGAAAACACCGGCGGGTTTCTTCTTCTCTGTTTCCACCGACCGTGCCCG
GTGTTCGTTGCCGTTTCTGCTGTTTCGCTGGAACGTGACTTCGAACAACGACCTGCCGAAACCGTACCTGCTGCGTGA
ACTGTCTTGGATGCTGGGTACAACCAAAGTTGGGTAACAAAGTTGAATCTGAAGAAAAAGCGTTCGTCTGAACGCTCA
AATCCGTCCGGGTTCTGCGGTTCCCGGCGGTGGAACAGTTCGCAACGCCAGAACAGTCA
GACCCTGTGCGTTCCGTTATCCACGCGGACATGAACGCGGCAGAACCTGCCAGCGTGCGTCTTCGGTCGTTGC
GGTGAAGCGTTCCGCTCTGTTTGCCAGCCGACCAGTCGACGCCACGGGCAGCGTTCTGCCGTGCGTCTCGCGGGTG
CGGTCGTCTGGGTGCGCTGACAGCTGGCGAAAACGGTCAGGGTGCGTTGAAAAAAAATCAACGCGTGCAGG
GTTCTACCTCAGATGACGAACCGTTTCGTTAGAATGTTCTGTTCTGCCGGAAGAAGACAGCGACACCGGTCGTA
ACAACAACGGTGACGACGAACTGGAAGACGTTCTGTCTGTTTCCCGTGCAACGTTTGGATCCGGCGAAACAGTTCTGG
TCACCGGTTTCCGTGACTCTTCTGACTCTATCTTCTCCGTCACTTCTGGGTTAAGAAATCATCCTTAGCG
CCGGAGGGGTTCTCTGCGATGATGTCGATGATGTGAAATGTAGGCGTCACTCTGGGTTAAGAAATCATCCTTAGCG
AAAGGTAAGGATTTTTTATTCTGAAATGTAGGAGACCCTCAGTTAAATATTCACTCAGGAAGTTATT
ACTCAGGAAGCAAAGAGGATTACA |

TABLE 6-continued

SEQUENCE LISTING

| SEQ ID NO: | Sequence |
|---|---|
| SEQ ID NO: 76 | AATCAGGAGAGCGTTTCAATCCTACCTCTGGCCAGTTGATATGTCAAACAGTTGCCGTCACTGCGTC<br>TTTTACTGGCTCTTCTCGCTAACCCGGTAACCCGGTAACCCGTTATTAATCACGGCAGAAAGCATTCGTTAACAAAGCGGGA<br>CCAAAGCCATGACAAAACGCGTAACACAAAAGTGTCTATAATCACGGCAGAAAGTCCACATTGATTATT<br>TGCACGGCGTCACACTTGCTATGCCATAGCATTTTATCCATAAGATTAGCGGATCCTACCTGACGCTT<br>TTATCGCAACTCTCTACTGTTTCTCCATACCCGTTTTTTTGGGCTAGCAGTAATACGACTCACTATAGGG<br>GTCTCATCTCGTGTGAGATAGGCGGAGATACGAACTTTAAGAGGAGATATACCATGCACCATCATCAT<br>CACCATACCAAACTGCTTCACCGTCAGAGAAAAACTGACCCACGACTGGGCGGTTCTAAAAACGTGAA<br>GTTCTGGGTTCTAACGGTAAACTGCAGAACGCCGTGCGACCAAAGGTGAAATGACCACGGTCGTAAAAACATG<br>TTCCCTAAAGCGTTCTCTGCGTACGGCGTTGCGACCAAAGGTGAAATGACCACGGTCGTAAAAACATG<br>TTCACCCACTCTTTCGACCGTTCAAACCGTCTGCACCAACTCTGCGAACCTGGGCGACAAAGCG<br>TACCAGTCTCTGCACTCTTACCTGCGCGGTTCTCTGGCCGCACTTCCTGCTCTGCCACGCGCTGGGTTT<br>CCGTATCTTCTCTAAATCTGTGAAGCGACCGCGTTCAGGCGTCTTCTAAATGAAGCGTACGAATCT<br>AAACTGGCGTCTGAACTGCGTGCGTTGACCGTTCTATCCAGAACCTGACCATCTCACCCGTTCAACG<br>CGCTGACCACCTCTGTTCGTGTAAAGGTGAAGAAACCTCTGCGAACCTGATCGCGCGTTTCTACAC<br>CCTGCTGACCGGTAAACCGTCTGTCTCTGACACCCAGGGTCCGGAACGTCGACCTGGCGGAAGTTATCTC<br>TCGTAAATCGCGTCTCTTCTTCGGTACCTGGAAAGAAATGACCGCAACCGTCGACCTGTCTGCAGTTC<br>TCGAAGAAGAACTGCACGCGCTGACGCGGTTCTCTGTCTCCGGCGTTCGACGTTCTGATCAAAA<br>TGAACGACCTGCAGGGTGACCTGAAAAACCGTCGAAAACCGGTCGAAAACCGGTTGACCCGACCCGGTTTCGAAT<br>ACAACCGGAAGACCCCGGCGGACATCATCAAACTGACCGCGCGTTACGCGAAAGAAGCGGTTATC<br>AAAAACCAGAACGTTGGTAACTACGTTCTCTGCTGCCGGTTTCTACCGACGACGAACTGCTGAATTCATCGGTGTG<br>CTGCTGAACAAAGGTCTGTCTCTGCTTGCCGGTTTCTACCGACGACGAACTGCTGAATTCATCGGTGTG<br>AACGTTCTCACCCGTCTTGCCACGCGCTGATCGCCCAGCTGACGTCGGAAGCGCCGAACTGTTCG<br>AAAAACGTTTCTCTGACACCCGTTCTGAAGTTCAGGTATGATCAGTCGACTCTCGGTTCTAACCACAT<br>CGGCGCTCTGTCTCTTCTTCGTAACTCTCTGCTTATGAGACTCTGAAGAACTGAAACGTCTGATCAAATCTT<br>TCCAGATCCACACCCCGACTGCTCTGCTTCTGTTCATCGGTGCGACAGCTCTGTCTCAGCAGCTGAATTCT<br>GCCGAAGCGCTGACCTGGTTGGTGTTAACTCTCGGACATCTGCTGGGTTCTACCCAGTACATGCTGACC<br>AACTCTCTGTTGAAGAATTATCGCGACCTACCAGCAGACCGACCTTAACCCTATCAACTACCTGTCTGGTG<br>TTGCCGGTCAGATCAACGGTGCGATCAACGTGCGATCAAAACGTAAAGCGATCAGCCGGTTATCGACGTTGAATCCACCCGCGGG<br>GCTGGTCTGAACTGATCTCTCGCCGTTCATCGCGTTATCGGTCAGCCGGTTATCGACGTTGAATCTGACCTGGCGC<br>ACCTGAAAAACCAGTACCAGACCCCTGTTCTTAACGAATTCCAGCAGATTCGACCACCCTGATCTCTGCGCTGCAGAAAAACT<br>TCGACCTGAACTTCAACAAAGCGTGCTGACACTTCGAAGCGATGTGCCGTTCTACCA<br>AAAAAAACGCGCTGGTTCTCTGGTCGTCTAAACGCGGAAATCGTTCTTCTACCCTGACCTGCTGGCGCGCTCTGACCTTTGCCT<br>GTACCGTGGTTCTGGTTCGTGCGCGATCGTGCGGGTATCAACAACACCCTTCGTTTTCGTCTGACCCGTAAAG<br>AACTCTGAACTGCGTGAACACCTTCTGCAGACTTTGTTGTGTTTAACCGCGCGATCAACGTAAACACTTCGTTTTCGCGTCTGGACCCGTAAAG<br>CGAAAAAACTGCTCTGCTCTGAACGACTCTCCTCTCGGACGTCTGCACGTTATCGACGAAATCCTGCAGC<br>ACGACAACTGGAAAACAAAGACCCTGAATCTCTGGCTGGTTCGTTCGTTCGTTCGTTCGTTGGCGCCGGTCT<br>GCCCGGACCAGCTGTCTCTTCTTCTCATCAACCTGCCGATCATCAACCCCAGAAAGGTGACCGTCGTCGATC<br>GACCTGATCGATACGACGAAGTTGCTGTTCGGTTTATGCTCGTTTGGGTTTACCTGCGTTCAAATCTA<br>ACCTCTGTCTGACTACCGGTGCGAACAAACAGTCTTTGTTACCCGTACCCTGTCTCCGTACCT<br>GGGTTCTAAACTGGTTTACGTTCCGAAAGACAAAGACAACCTGGCGTGGTTCCGTCTCAGATGTTCGAAGGTCGT<br>TTCGCGGACATCCTGCAGTCTGACTACATGTGTTTTGAAAGACGCGGGTCTGTGCGTTATCGACGACCG<br>CGAAACACCTGCTAACATCAAAAAATCTGTTTCTTCTCTGAAGAAGTTCTGCGTTCCTGCGTGAACT<br>GCCCGGAACTTCATCCAGACGAAGTTGTGGTTAACGTTGACGTATCGCGTTCAAC<br>AACGGTGACATCCCGTCTCTGAAACTTCTCTAACTGCTTCAGTGGTAAAGTTTCTCGTACCAACCT<br>CTCTGGTTCAGACCCTGACGTTGGTTCGAAGGTGGTAAAGTTTCTCCGCCGTCTATCCAGTTCGAACG<br>TGCGTACTACAAAAAGACGACCAGATCACGAAGACGGCGGAAGCTAAAATCGTTTCCAGATGC<br>CGGCGACCGAACTGGTTCACGCGTCAGACAGGTTCGACCCGTCTTACCTGCTGTCTGGGTATCGACC<br>CGGGTGAATACGGTATGGGTCTGTCTCTGGTTTCTATCATCAACAACGGTAAAATCGTTTCTGGACTTCAT |

TABLE 6-continued

SEQUENCE LISTING

| SEQ ID NO: | Sequence |
|---|---|
| | CCACATCAACTCTCTGATCAACTTCGCTGTCTAAAAATCTAACCACCAGACCAAAGTTGTTCCGCGTCAG<br>CAGTACAAATCTCCGTACGCGAACTACCTGGAACAGTCTAAAGACTCTGCCGCGGGTGACATCGCGAC<br>ATCCTGGACCGCTCTGATCTACAAACTGAACGCGCTGTCTTTCTACACCTGGGGTGACAAACGACGCCAGAACT<br>CTGCGGCGACCAGGTTTGGACCAAAGTTCTGTCTTTCTACACCTGGGGTGACAACGACGCGCAGAACT<br>CTATCCGTAAACAGCACTGGTTCGGTGCGTCACTGGACATCAAAGGTATGCTGCGTCAGCCGCCGA<br>CCGAAAAAAAACCGAAACCTATCATCCGTGTTCCCGGGTTCTCAGGTTCTTCTTACGGTAACTCTCAGCG<br>TTGCTCTTGCTGCGTCGTAACCCGAACCAGTCTGGTGAACATGGCGAAAGACACCCTCTATCAAGA<br>ACTGAAAATCCGTAACTCTGAAATCCAGCTGTTCGACGTGTACCATCAACATGTTCAACCCGGACCCGTCT<br>ACCGTTATCGCAACGTCGTCGTCACAACCTGGGTCCGTCTGTATCCGTTCTCGTTCTACCCCGTTCAAAA<br>ACATCTCCCGCTTTCTCTGAATTCAAAGAACTGATCACCATGCTTTCTCGTTCACTCCTCGTTCACTCTCCG<br>GAATTCGTCGAAAAACGTGGTATCGGTTCTGAATACTCTGCGCGTACTCTGACTGCAACTCTTCTC<br>TGAACTCTGAAGCGAACGCGCGCGAAGCTAAGGATTTTTTTATCTGAAATGTAGGGAGACCTGTTCTTCTGAACTGT<br>AAGAAATCATCCTTAGCGAAGCTAAGGATTTTTTTATCTGAAATGTAGGGAGACCCTGTTCTTCTGAACTGT<br>ATTCACTCAGGAAGTTATTACTCAGGAAGCAAAGAGGATTACA |
| SEQ ID NO: 77 | AATCAGGAGAGCGTTTTCAATCCTACCTCTGGCGCAGTTGATATGTCAAACAGGTTGCCCTCACTGCGTC<br>TTTTACTGGCTCTCTCGCTAACCAAACCGGTAACCCCGCTTATTAAAGCATTCTGTAACAAAGCGGGA<br>CCAAAGCCATGACACAAAACGGTAACAAAGTGTCTATAATCACGGCAGAAAGTCCACATTGATTATT<br>TGCACGGCGTCACACTTTGCTCATGACATTTTATCCATAAGATTAGCGACATTCTACCTGACGCTT<br>TTTATCGCAACTCTCTACTGTTCTCCATACCCGTTTTTTGGGCTAGCAGTAATACGACTCACTATAGGG<br>GTCTCATCTCGTGAGATAGGCGGAGATACGAACTTTAAGAGGAACTTCGCGGCCGCTGTCTGTTCCGTGGTTAAGGTTCTG<br>AACTGGTTAAAACCGTTAAATACCCGTCGGTTCTCCCGGTTCAGGGTGCGTTGAAGAACTGGCGAAG<br>CGATCCGTCACGACAACCTGCACCTTGTCGGTCAGAAAGAATCTTGACCTGATGGAAAAAGACGAAG<br>GTACCCAGGTTACTCTGTTGACTTCGGCTGGACACCCTCGGGTATGTTCTCTCCGCTCT<br>GCGAACGCGCTGAAATCACCCGGTAAATTCAACTCTGACCAGGTTTCTCCGTTCCGTAAAGTTCTGG<br>AACAGTCTCCGTTCTCCTGGCGGTCGTCTGAAAGTTGAACGGCGAACGTATCCTGTCTGTTGAAAT<br>CCGTAAAATCGGTAAACGTGAAAACGTATCTATCCAGAAACTGCGGCGACCATCTGGGACTCTAAAGACCA<br>TCAGCTGTCTTCTGACGAAAACAGTCTATCCAGAAACTGCGGCGACCATCTGGGACTCTAAAGACCA<br>CGAAGAACAGCGTATGCTGAAAACGAAACGTCCGGTAAACAGAAACCGTGATCAAAGCGGTTAC<br>CGGAACTGTACCACCCGTGGTTTCGTTCTATCGCGGACTTCCTGTTCAGCGTCTGACCCTGCTGCGTGA<br>CAAAATGTACCGACACCCGTGGGTACCTTCGGGTAACCTGCAGGGTGACGGTTTCGAACAGATCTTCCAGT<br>CATGCTGGGTTCTTACGTTGGTTGGCAGGGTAAAGAAGACGTTCTGCGTAACCTCTGGCTGGC<br>GGAAAAGTTAAACCTCTGCAGAAATTCGCTGGGGTGAATGGTCTGGTCACCGTATGTTCCTGCA<br>CGGTCAGCTGAAATCTGGTCTTCTAACTTCTTCCGTCTGATCTCTTACGTTGAAGAAAAGGTGTTACCACCCG<br>ATCAAATCTGACATCCAGCACGCAACCATGCTGAACTGCTGACTGCCGGCCGCCGGTTGAGAAAAGTTCTGACCCG<br>GAAATGCAAATGACCACATGCTGGAAGCGGTTCGTTCTTACATCATGATCCACAAATCTGTTGCGGGTT<br>TCCTGCCGGACCTGCTGGAATCTGGACCGTGACAAAGACCGTGAATTCGCGGTCTATCTTCCGCG<br>TATCCGGAAATCGACAAAAAAACAAAGAAATCGTTGCTGGGGAACTGCCGTGAACCGAAGAAG<br>GTTACCTGTTCACCCGAACAACCTGTTCGTAACTTCGTGGAAAACCTGAAAACACGTTCGCGTTTCAT<br>GGCGAACGTATCCCGGAAGCATGACCGTCCGTCTCGCGTTGGTTCGACGCTATGGTTAA<br>ACAGTGGCAGAAGTTGTTAACCAGCTGCGATCTGACCGTTGAATCCGGGTGCGCTGATTCCGAGACCGAAATCTTTC<br>CTGCGTCAGCGCTGCAGGCGATGTCGAGCTGACCGTTGAATCCGGGTGCGCTGACCAGAATCCGAAAATTCCTGAAA<br>CTTGCCAAAATGACCCACATGCTGGAAGCCTTGGTGGTAAACGTAACGTCTGTCCGGCGACGTTTACCACCGC<br>GTGCCAAGGTCTGGCGATCCGTCTGCGTGAAACCTGGGTTTCGAATGGGAAAAACCTGAAAGGTCACGA |

TABLE 6-continued

SEQUENCE LISTING

| SEQ ID NO: | Sequence |
|---|---|
| | ACGTGAAGACTTCCTGCCTCTGCACCAGCTGCTGGTAACCTGCTGTTCTGGATCCGTCAGCGCGAAACTG GTTGTTAAACTGGAAGACTGGATGAACAACCCGTGCCTTCAGGAATACGTTGAAGCGCGTAAAGCGATC GACCTGGCCGCTGGAACTGTCGGTTTCGAAATCTTCGATCTTCCTGAAACGTTACCTGTTCTGAACTGC GTCAGCTGGAACTGCTGTCGCTCGTAAATCGTTATGACCTCTTACTCTGTTAAAACACCGGTTCTCC GAACCGTCTGTTCCAGCTGGTTCCAGCTGGACACCCCGTCGAACCCGTCGACCTGACCCGGAAAAAAACTCTAACAA CTTCCAGGAACGTCTGGACACCCCGGTTCTGGTCGTGTTCCTGACCCTGACCCTGGACGCGTTC GCGGTAAACTGCTGCCGACCCGGTTACCCAGGAACCATGGCGGGTTCTACGACCCTG TTCGGTTTCAAACTGCCGTCCAAACTGGCGGCGATGTCTAACATCGGTTTCGAAACCCGGGTTCTCTTCTTAAAATGGTTG TTCTGGCGAAACCGAAAAAAGGTGTTGCGCTCACATGCGAATCGAAATACCCGAAGTCTGCTGTACCTGCCGGAAGA CACCCGCTGACATCGAACTGGGCGGAAACCTCTGTTTCTGTCGCAGTCGGCCGTTCAAACT TGAAAAACCTGACCACCATCTCGGGGTTGTTGGCTAAATCGGTAAACCTACCTGGGTCTGACGCGGGTGA ACGTTCTGGTTGTTGGTTTCCGATCGTCCGATCGTTACCGTTGACGGTTACGAAGTTCAGCGTCTGGGTGTT CACGGAGACACCCCAGCTGATGGCCGTGCGCTAAATCCTGGAAGAAACCGGTTTTTCCAG CCGCTGCGTAAAGTTACCTTCCGTCAGCAGGAACCTACCGGAAAGTTGTTCACGAAAGCGAAATCTGTTGGTTCTGGTCT TCTACCACGCGCTGATGAATCAAATACCGTCGAAAGACTCTGAAAAAAAGCGGGAACGTTCTGCCGAAAAGGTG GTATTGGTCAGTGGCTGCCGTCGTTCCAGAAGAACCTGAAAACTCTCTGGCAGAGAACACCCGTGGGGTGCGTTCT CTAAAAAACGTGTTGACAAAAAAAACGTGAATCTTCTGCCAGGACACCCGTGGGGTGCGTTCT GCCGGTTGGTTGTTGGTTCCAGCTGGGTATGCCGTGATGCAGATCGGAATCGTTGAAAGCTGTCAGGAATGTGTTGTTCTCCCAGCAG GAACCGTTCTATCGTTCCTGACACTGCGAATCTCAAAAAAATGGTTCGTGACTTCATGCGCTCGCCGCG CTGGAAAAGTTTCCTCCGGAATCGCGGCGTACGAACGTTCGTTCTTGTGTCTCGTCACCCGTCGTT ATGTTCGACCGTAAAGTCTCTCCGGCGGCCAGTGTTTTCGAAGTCGCAGGAACGGTCGGATCGGATCGCAACAAGG ACCGTTTCGACAAGTTTTCGACCACCTCTTCGAACAGTGCTGCGTTTACGTTCGGCGCTGATCGGTATCGGCGGACAAAG AAGGTATGTCTGGTAAAAACTGGTTTGAAGACAGTCTTCTGCGCAGTAAGAACATCCTTGCGAAAGCAAG AACTGAACTTCTGTGTGAAATGTAGGGAGACCCTCAGGTTAAATATTCACTCAGGAAGTTATTACTCAGGAA GCAAGAGGATTACA |
| SEQ ID NO: 78 | AATCAGGAGAGCGTTTTCAATCCTACCTCTGGCGCCAGTTGATATGCAGTTGCAAACAGGTTGCCTCACTGCGTC TTTTACTGGCTCTTCTCGCTAAACAAACCCGTAACCCGCTTATTATCACGCAGAAAAGCATTCTGTAACAAAGCGGGA CCAAAGCCATGACAAAAACCGTAACAAAAGCGTCTATAATCACGCAGAAAAGTCCATTGATTATT TGCACGGCGTCACACTTGCTATGCCAGCATAGCGTTTTATCCATAAGATTTAGCGATCCTACCTGACGCTT TTTATCGCAACTCTCTACTGTTTCTCCATACCGTTTTTGGCTAGCAGTAATAAGACTACTATAGGG GTCTCATCTCGTGAGATAGGCGGAGATACGAGTGCCGTAAATGCCGTGCGCTTATGAAATACGAAGTTATCGGT CACCATGCGGAATCTAAACAGATGCAGTGCCGTTAACATGCCCGGACTGCCGTCTAAAGCGCTTCTCAGCGTATCGCGGTTGCG AACAAAAAAAAATCGTGACAAAAAATACGGTTCGCGCTCTAAAGCCGATCCAGGAAGAACCTACCAAATACCCGGCGACCTGAACGGT GGTGCGCTGTACCGACTCTGGTGTTGCCGGACAAAAATCGCCAGGCGATCCAGGAAGACGAAATCGGTCTGCTG GAAGTTCACGACTCTTGGTGTTGCCGGGTGGATCGCGTTCAGAAACAGTCTGAACCGGTACCGGTTCTGTTGTTGACT TCTGGTTCGACCGCGTTTGCCGTCTGTCTGCGGCTGCCTGCCGCTCTACCGTTCTG CAGCTGTCTGGTGAAGAAATTCCTGAAGGCTCTGTTCTGCGGCTCGTCGTTCTCCGTTCAGGACAACATCAACC TGGCCAGGCGGAAATCCGTCAGGTCGTGGGTATCAAAGACCGTATGCGTAAACGTATCG CGAATGCTTCGCGGAGCAGAATCGTCTGGAAGCGCTGATGCGCGAAACTGAAATTTCGGTATCTCAGA TGCCCGAAGCGAAACAGTGAACAACGACTCTGGTCTGACGCTTTGCATCTCGCCGACTACGTTC |

TABLE 6-continued

SEQUENCE LISTING

| SEQ ID NO: | Sequence |
|---|---|
| | CGGAGAAAACCGTGCGGACCAGCTGGTTGTTCTGCTGCTCGTCTGCCGTGAAATCGCGTACTGCATGG
GTATCGAAGACGAAGCGGGTTTCGAACACCTGGGTATCGACCCGGGTGCGTCTGAACTTCTCTAACG
GTAACCCGAAACGTGGTTCTGTCTGCTGAAACAACGACATCATGCGCTGGCGAACAACATGT
CTGCGATGACCCCGTACTGGGAAGGTCGTAAAGTGAACTGATCGAACGTCTGCGTGCTGAACACC
CTGCCGAAGGTCTGTACCTGAAAGAACCGCACTTCGGTAACTCTGGTAAACTGAAAATCGAACGTTCTCGTATCTT
CTTCGTATCGCGGTTGGCTGTCGTGTTGCGCGGTAACGTCTGGTTCGACCCGTTCTCTGACAACGTCTCCGGAC
TGTTCGTACCGACCTGTTCTGCTGAAACGTCTGGACGCCGGTTCGTCTTGGAAGCGCGGAATCTTCTCAGGACCCGGCGGAAC
AGGTTCGTGCGCGTTGCTGCGCTTCCACCTGAACAACGCGCCGCGGTTCGTTCTTATCCGGAACAAAGCGGTTCA
GCGTTCTGACTCTTCTCTGAACACCGGTAAAAAAAAGGTGCGAACTCTAACGGTGCGCCGTCTGA
AGAAGAATACACCCGAAACCGAATCTATCCAGCAGCCGGAAGACGCGGAAGACAGGAAGTTAACGTCAGG
AAGTTAACGGTGCGTCTAAAAACCAGAAAAAATTCCAGCGTATCCGCGTTTCTTCGGTGAAGGTTCTC
GTTCTGAATACCGTATCCTGACCGAAGCGCCGCAGTACTTCGACATGTTCTGCAACAACATGCGTGCGAT
CTTCATGCAGCTGGAATCTGAATCGTAAAGCGCCGACTTCTCGTGCAGAACCGTCTG
CAGAAACTGTACAAACAGACCTTCCTGAACGCGCGTTCTAACAACGCCCTGCGCGCTCTGAATCTGTT
CTGATCTCTTGGGGTGAATTCTACACCTACGGTGCGAACGCAGAAAAAAAATTCCGTCTGCGTCACGAAGCG
TCGAACGTTCTTCTGACCCGGACTACGTTGTTGCAGCGCGTGGAAATCGCGCTGCTGTTCCTGT
TCGGTTTCGAATGGCGTGACTCGTCGCGGTGAACGTGTTGACCTGGTGTGAAATCCACAAAAAGCGA
TCTCTTTTCCTGCTGGCGATCACCCCAGGCGGAAGTTCTGTTGGTTCTTACAACTGGCTGGTAACTCTACC
GTTTCGAGTTACCTGTCTGTTGCGGTACCGACACCCGTACGGTACCCAGCTGGAAGAATTCCTGAACG
CGACCGTTCTGTTCTCAGATGCGTGGTTCGGCAGCGATCGTCTGTCTTCAGGAACTGAAAGACGGTTTCGA
CGTTCAGCTGGAATCTTCTGCCGAACCTGACCGTTGTTTACCCGTCGTCTGTGACCCTG
GCGCGGTGCAAACGTGCACCTGCCGGCAGAACGTGGTTCGACGGAAACTGGTTCGCCGTTGGTGCG
TTCATCGCGCTCTGTTATGAAAATGATCGAACGTGGTGACGAACGTGGTGCGGGTTCGCCGTACCGCTGACCAC
CGTCCGCACTCTTTCGGTTGGCAGATCCGTTCGTGTTGCGGAAGTTGGTATGGACCAGGGTACCG
CGCTGCGTTCCAGAAACCGACCGATCTGAACCGTTAACCGTTCAAAATCAAACCGTTCTGACCGTTACGGTC
CGGTTCTGTGCTGAACTCTTCTTCTTACTCTCAGTCTCAGTACCTGGACGGTTCCTGTCTCAGCAGCGAAA
AACTGGTCTATGCGGGTATAAATGCGTTCTGCCCAGGCGGGTTCTGTTCTGTCGCGGTGTGCCGTGATCTGAA
ACCTGCCAGGCGGGGTATCTGTCTGGTGACGAAGCGGTTCTGGCGCCGAACCGTGCGTTCTTCATGCCGTTCCGTTCTC
TTTCCGTCCGTCGTTCTGTTCTGTTTCGACAAGCGGTTCTGGACGTTTGACTCTGGAATCTGGAACGTGGTA
TCTGGTGGTATCGAATACCGCGGTTGTTGACGTTCTGGACTCTGGGGTTTCAAAATCCTGGAACGTGGTA
CCATCGCGGTTAACCGTTTCTCTCAGAAACGTGGTGAAACGTCAGGAAGAAGCGCACCGTGAAAAACAGC
GTCGGTTATCTGACATCGGTCTGAAAAAACCGGTTCAGGCCGTATCCGTTCGTTGTTCAGGCGGCGAACGAACTGC
ACCGTAAATACACCCACGTTGCGACCGACGCCGCAGCCGA
AACCGGTACCGCGCGACCGCGACCACGCGGTATGACCTTTACGCGCGTCGCGTTGTTACCGAAGCGCGCGTTCTG
GTAACCAGGAAGACATCCTGGGTATCTCTACCCAGGTTTACTGGACCGGTGGTATCGGTGAATCTTGCCC
GGCGGTTGCGGTTGCCTGCTGGGTCTGGGTATGCCGCACCCGAGGCGCCGGAAATAAGAGAATGGAAAAGAAGA
AGTTGTTTCGGTGGTCTGAAAAAAATTCTTCCGTCTTAAGAAATCATCCTTAGCGAAAGTAAGGATTT
TTTTATCGAAATGAAATGTAGGAGAGCCCCTCAGGTTAAATATTCACTCAGGAAGTTATTACTCAGGAGCAAA
GAGGATTACA |
| SEQ ID NO: 79 | AATCAGGAGAGCGTTTCAATCTCACCTCTGGCCGCCAGTTGATATGTCAAACAGGTTGCCGTCACTGCGTC
TTTACTGGCTCTTCTCGCTAACCAAACCGGTACGCCGTTATTAAACCATTCTGTAACAAAGCGGGA
CCAAAGCCATGACAAAACGCGTAACAAACGTCTATAATCACGGCAGAAAGTTCCATTGATTATT
TGCACGGCCGTCACACTTTGCTATGCCATAGCATTTTATCCATAAGATTAGCAGATCCTTACCTGACGCTT
TTATTGCAACTCTCTCACTGTTTCCCATACCCGTTTTTTGGGCTAGCAGTAATACGACTCACTATAGGG
GTCTCATCTCGTGTGAGATAGGCCGAGATACGAACTTTAAGAAGGAGGATATACCATGCACCATCATCAT |

TABLE 6-continued

SEQUENCE LISTING

| SEQ ID NO: | Sequence |
|---|---|
| | CACCATGAAAAACGTATCAACAAATCCGTAAAAAACTGTCTGCGGACAACGCGACCAAACCGGTTTCT |
| | CGTTCTGGTCCGATGAAAACCCTGCTGTTCGTTGTTATGATGACCGACGACGTTAAAAAACGCTGAAAAA |
| | CGTTCGTAAAAAACCGGAAGTTATGCCGAAGGCGATCCTGCCAGGTTATCTCTAACAACGGGGAACAACCTGCGTATGCTG |
| | CTGGACGACTACACCAAATGAAAAGAAGCGATCCTGCCAGGTTTACTGGCAGGAATTCAAAGACGACCA |
| | CGTTGGTCTGATGTGCAAATTCGCCAGCCGGCCGCTCTAAAAAAATCGACCAGAACAAACTGAAACGGA |
| | AATGGACGAAAAAGTAACCTGACCACCGCGGGTTTCGCCGTCTCAGTGCGTCAGCCGCTGTTCGT |
| | TTACAAACTGGAACAGGTTTCTGAAAAAGTAAAGCGTAAAAACTACCACTACTTCGGTCGTTCAACGTTGC |
| | GGAACACGAAAAACTGATCCTGCGGCAGCTGAAACCGGAAAAAGACTCTGACGAAGCGGTTACCT |
| | ACTTCTGGGTAAATTCGGTGGCTGCCAGCTGCCGGACTTTCTACTCTTACCACGTTACCACAAGAATCTACCCA |
| | CCCGGTTAAACCGTGGCCAGATCGGCGTAACCGCTTACGGCGTCTGGTCCGGTTGGTAAAGCCTGTC |
| | TGACGCGTGCATGGGTACCATCGCGTCTTTCCCGGTTGTCTAAATACGAACATCATCGAACACCAGA |
| | AGTTGTTAAAGGTAACCAGAAAAACGTCTGGAATCTCGCGTGAACCTGGCCGGGTAAAGAAAAACCTGGAATA |
| | CCCGTCTGTTACCCTGCCCGCCAGCCGCACACCAAAGAAGGTGTTGACGCGTACAACGAAGTTATCGC |
| | GCGTTCGTATGTGGGTTAACCTGAACCTGTGGCAGAAACTGAAACTGTCTCGTGACGACGCGAAAACC |
| | GCTGCGCGTCGAAAGGTTTCCCGGTTCCCGGTTGTGAACGTGTGAAAACGAAGTTGACTGGTGG |
| | AACACCATCAACGAAGTTAAAAAACGTAAAAACGCGAAACGTGACACGTGGGCGTGTGTTCGTGGTCGTGT |
| | GTTACCGCCGGAAAAACGTAACACGTCTGGAAGTTACAACTACCTGCCGACGAAACGACACTA |
| | AAAACGTGAAGGTTCTCTGGAAAAACCGGCTGAAAAAAACCGGTAAGTTTTCGACGAAGCGTATCGACAAAA |
| | CCTGGAAAAAAAATACGCGGTGACTGGGGTAAAGTTTTCGACGAAGCGTATCGACAAAA |
| | AAATCGCGGGTCTGACCTCTCACATCGAACGTGAAGAAGCGCGTAACGCCGGAAGACGCGCAGTGCTAA |
| | GCGGTTCTGACCGACTGGCTGCGTGCGAAATCAGCTGCAGAATGCGTCTTTCGTTCTGGAACGCTGAAAAGAAATGGACGAA |
| | AAAGAATTCTACGGCGTGCGAAATCAGCTGCAGAATGCGTCTTTCGTTCTGGGTAACCGTCGCG |
| | GTTGAAGCGGAAAAACCGGTCGTGTTGACAATCTCTGTTTCTCATCGTTCACCGGTTCACTCTATCCAGT |
| | ACGTAACCTGCTGCGTGCGGTGAAATACCTGGAAATCGCGAAAAACGGTAAACGTAAATTCTACCTGTGATGAACTACG |
| | GTAAAAAGGTCGTATCCGTTTCACCGACGGTAAAGTTATCGACCTTGAATTCATCTGCGACGACACCAGCTGATCATCC |
| | TGCCCGCTGGCGTTCGGTACCCGTCGGTTATCTGAAAGCGAAAGTCTGCTGTCTCTGGAAACCGG |
| | TCTGATCAAACTGGCGAACGTCGTGTTGTTATCGAAAAAACATCTACAACAAAAATCGTCGTGACGA |
| | ACCGGCCGTGTTCGTTGCCGGTGTTGACCTGGTGACCTTCGAAGTCGTGAAGTTGTTGAACATCTAACATCAAACCGGTT |
| | AACTTGATCGGTGTTGACCGTGGTGAAAACATCCCGGCCGGTTATCGCGCTGACCACCCGGAAGGTTGC |
| | CCGCTGCCGGAATTCAAAGACTCTTCGAGAAGACTGCAGCCGGTCGTCGGGGTGGTTACTCTCGTAA |
| | GAAAAACAGCGTGCATCCAGGCCGGCGAAAGAAGGTGAACAGCGTCGTGCGGGTGGTTACTCTCGTAA |
| | ATTCGCGTCTAAATCGTAAACTCGGCGGACGACATGGTTCGTAACTCTCGCCGTGTTCTGACCGTTCTACCAC |
| | GCGGTTACCCACGACGCGGTTCGTGTTTCGAAAACCGTCTCCGTGGTTTCGTCGTCAGGGTAAACGTA |
| | CCTTCATGACCGAACCGAGTACACCGGAAGAATGGAAGACTGCCGTGACCGGCGAAACTGGCGTACGAAGGTC |
| | TGACCTCTAAAAACCTACCTGCTCTAAAAAACCTCTAAAAATCTGCTCTAACTGCGGTTT |
| | CACCATCACCACCGCGGGACTACGACGGTATGCTGGTCGTCAGCCGGTATGCCAGGTGGGCCGAC |
| | CACCCTGAACAACAAAGAACTGTCTGCGGAAGGTCAGATCAGATCGTGCTGCACCAGGGTGAAACGTCAGA |
| | CCGTTGAAAAAGAACTGTCTGTGAGGAAGCGGTTCTTCCTGCGAAAAAACGTTTCTCGCTCCGGTTCA |
| | AATGGACCAAAGGTCGTTGCCTGACCTGCGGTCACGAAGTTCACGGAGACAGGCCGGCGCTGAACATCGC |
| | GGAACAGTTCTGTTCCTGACTCGCGTCGTCACGAAGTTCACCGGAAGACAGGCCGGCGCTGAACATCGC |
| | GCGTTCTTGGCTGTTCCTGACTCGCGTCTAACTCTCTAACCGAAGTTCACCGGGACAGGCCGGCGCTGAACATCGC |
| | GTTGGTCGTGGCCAGGCGTTCTACAAACGTCGTCGTGTGCAAGCGAAAGGTTTGGAAACCGTAAGAAATC |
| | ATCCTTAGCGAACGTAAGGATTTTTTTATCTGAAATGAAGGCGAACGTCGTGCTGAAACCGGTAAGAAATC |
| | GGAAGTTATTACTCAGGAAGCAAAGAGGATTACA |

| SEQ ID NO: 80 | AATCAGGAGGAGCGTTTTCAATCCTACCTCTGGCCGCAGTTGATATGTCAAACAGGTTGCCGTCACTGCGTC |
| | TTTTACTGCGGCCTTCGTCGCTAACCAAACCGGTAACCCGCTTATTACACGGCAGAAAGCATTCGTAACAAAGCGGGA |
| | CCAAAGCCATGACGAAAAAACGGTAACAAACGGTGTTATAATCACGGCAGAAAGTTCCACATTGATTATT |

TABLE 6-continued

SEQUENCE LISTING

| SEQ ID NO: | Sequence |
|---|---|
| | TGCAGGGCGTCACACTTTGCTATGCCATAGCATTTTATCCATAAGATTAGCGGATCCTACCTGACGCTT<br>TTTATCGCAACTCTCTACTGTTTCTCCATACCCGTTTTTTGGGCTAGCAGTAATACGACTCACTATAGGG<br>GTCTCATCTGTGTGAGATAGGCGGAGATACGAACTTTAAGAGGAGGATATACCATGCACCATCATCAT<br>CACCATAAACGTATCAACAAAATCCGTCGTCGTTGTTATGACCCCGACCTGCCGTGAACCTAAACCCAAAAAGCGGTAAA<br>ACCGGTCCGATGAAAACCTGCTGCTGTTCGTGTTATGACCCCGACCTGCCGTGAACGTCTGAAAACCTG<br>CGTAAAAACACCGAAATGAAAAACATCCGCAGCCGATCTCTAACACCTCTCGTGCAACCTAAACAAACTGCTG<br>ACCGACTACACCGAAATGAAAAAGCGATCCGCAGCCGATCCTCAAACACATCGACCAGCGTAAACTGTCCGGTTAAA<br>GGTCTGATGTCTCGTGTGCGCAGCCGGCCCGAAAAACATCGACCAGCGTAAACTGATCCCGGTTAAA<br>GACGTAACGAACGTCTGACCTCTTCTGGTTTCGCGTGCTCTCAGTGCTCGCCAGCCGTGTAACGTTTCTGAAC<br>AACTGGAACAGGTTAACGACAAAGGTAAACCGCACACCACTACTTCGGTCGTTGCAACGTTTCTGAAC<br>ACGAACGTCTGATCTGCTCTCCGCACAACCGGAAGCGAACGAACTGGTTACTACTCTCTGG<br>GTAAATTCGGTCAGCGTGCCGCTGGACTTCTACTCCACGTTATCCCGTTGAATCTAACCACCCGTTAA<br>ACCGCTGGAACAGATCGGTGGTAACTCTTGCGCGTCTGGTCCGGTTGGTAAAGCGCTGTCTGACGGTG<br>CATGGGTGCCGTTGCCTCTTTCCTGACCAAATACCAGGACATCATCCTGGAACACCAGAAAGTTATCAA<br>AAAAAGAGAAAACGTCTGCGAACATCGCTCTGCGAACCGGTCTGGCGTTCCCGAAA<br>TCACCCTGCCCGCAGCCGCCAGCCGGAACCTGTACAACAACGTTGTTGCGCAGATCG<br>TTATCTGGGTTAACCTGAACCTGTTCCCGCTGGTTGAACTGGCAGAATCGGTCGTGACGAAGCCGTGCAGC<br>GTCAACGTTAAAAAACTGATCAACGAACAAAAAGAAGACGGTAAAGTTTTCTGCAGAACCTGGCGG<br>TTGCAACGTCTTCTGAAGACGCCGCAGTCTAAAGCGGTAAAGTTTTCTGCAGAACCTGGCGG<br>GTTACAAACGTCAGGAAGCGCTGCTGCCCGTACCTGTCTTCTGAAGAAGACCGTAAAAAGGTAAAAAT<br>TCGCCGTTACCAGTTCGGTGAACCTGTCAACAAAAAGTTGAAGGTCTGTTAAACATCAAACATCAAACTGGAAG<br>AAGAACGTCGTTCTGAAGACGCGGATCTTCGAAAGCGGTAAAGTTTTCTGCCGAAAGCGTCTT<br>TCGTTATCGAAGGTCAGAAGGTCTGAAAGAAGCGGACAAAGACGAATTCTGCCGTTGCGAAACTGCAGAAAT<br>GGTACGGTGACCCTGCGCGTGTAAACCTTCATCTGCCGATCGAAGCGGAAAACTCTATCCTGGACATCTCTGGTTT<br>CTCTAAACAGTACAACTGCGCGTTCATCTGCCAGAAAGACGGTGTTAAAAAACTGAACCTGTACCTGAT<br>CATCAACTACTACCACCGTTATCAACAAAAATCTGTGAACAAAAATCAAACCGAAGCGTTCAAGCCGAACCG<br>TTTCTCACACCGTTATCATCCGCCGCTGGCCTTCTGAAACTGGCAGAACTGGTTACCTGAAAGAAGTTAACTTCAATCTGAACGACCTGC<br>CCGAACCTGATCATCCTGCCGCTGGCGTTCTGAAACTGGCAGAACTGGTTACCTGAAAGAAGTTAACTTCAATCTGAACGACCTGC<br>TGTTCTGGAAACCCGGTTCTGCAACCTGTGTCCGGCGAACCGGTCGTGTTATCGAACCTCGTGAAGTTCTGGACTCTTC<br>GTAACCGTCAGGACGAACCGGTGTATCGGTATCGACGTGGTGAAAACATCCCGGCGGTTATCGCGCTGAC<br>TAACATCAAACCGATGAACCTGATCGGTATCGACGTGGTGAAAACATCCCGGCGGTTATCGCGCTGAC<br>CGACCCGGAAGGTTGCCCGCTGTCTCCGCTGTCTGTTTCAAAGACTCTCTGGGTAACCCGTAACCCTGCGTATC<br>GGTGAATCTTACAAGAAAAACAGCCTACCATCCAGGCCGGCAGAAGAAGTTGAACAGCGTCGTGCGGG<br>TGGTTACTCTCGTAAATACCGCTTAAAGCGAAAAACCTGGCACGACATGGTCGTAACACCCGCGG<br>TGACCTGCTGTACTACGCGTTACCCAGGCGGATGCTGATCTTCGAAAACCTGTCTCGTGGTTTCGGT<br>CGTCAGGGTAAACGTACCTTCATGGCGGAACGTCAGTACACCCGTATGGAAGACTGGCTGACCGCGAA<br>CTGGCGTACGAAGGTCTGCCCGTCTAAAACCTGTCTAAAACCTGGCCGCAGTACACCTCTAAAACCT<br>GCTCTAACTGCGGTTTCACCATCACCTCTGCCGACTACGAACCTGTTCTGGAAAAAACCTGAAAAAAACCG<br>CGACCGGTTGGATGAACTGCACACCAGGTAAAGACCTGTCGTTAAAGAACCTGAAGGTCAGATCACCTACTACAACG<br>GTTACAAACGTCAGAACGTGTTAAGACCTGTCTTGTGTAAGCGCTGTCTCTGAAGATGTTAA<br>CAACGACATCTCTTCTGACCAAAGGTCGTTTGCCTGGACCTGCCGGTTTGCAAACCCACGCGGACAAGGCG<br>CACCACCCGGTTCAGGAAAAATTCGTTTGCCTGGACCTGCCGGTTTGCAAACCCACGCGGACAAGGCG<br>GCGCTGAACATCGCCGTTCTGGCTGTTCCTGCCGTTCTGTTGAACCTGGCAGTCTTTTTCTACCGTAAAAAACTGAA<br>ACCACCGGTAACACCGACAAACGTCGTTTAGCCAAGCTAAAGGATTTTTTATCTGAAATGTAGGGAGAC<br>GAAGTTTGAAACCGGAATCATCCTTAGCGAAGCTAAGGATTTTTTATCTGAAATGTAGGGAGAC<br>CCTCAGGTTAAAATATTCACTCAGGAAGTTATTACTCAGGAAGCAAGAGAGATTACA |

TABLE 6-continued

SEQUENCE LISTING

| SEQ ID NO: | Sequence |
|---|---|
| SEQ ID NO: 81 | tgccgtcactgcgtatttactggtctttctgctaaccaaaccgtaacccgcttataaagcattcttgtaacaaagcgggaccaaagctgacaaaaacgtaacaaa agtgtctataatcacggcagaaagtccacattgcacggcgcacactttgatgccatagcattttatccatagcgaattagcggatccctacctgacgctttatcgc aactctctactgtttctccatacccgttttttgggctagcaccgcctatctcgtgtgagataggcgagatacgaactttaagAAGGAGatatacc |
| SEQ ID NO: 82 | TGCCCTCACTGCGTCTTTTACTGGCTCTTCTCGCTAACCAAACCGGTAACCCCGCTTATTAAAAGCATTCT GTAACAAAGCGGGACCAAAGCCATGACAAAAACGCGTAACAAAGCGTAACACTTTGTCTATAATCACGGCAGAAAG TCCACATTGATTATTTGCACGGCGTCACACTTTGCTATGCCATAGCATTTTATCCATAGAGATTAGCGGAT CCTACCTGACGCTTTTATCGCAACTCTCTACTGTTTCTCCATACCCGTTTTTTGGGTAGCGGATCCTAC CTGAC |
| SEQ ID NO: 83 | AATCAGGAGAGCGTTTTCAATCCTACCTCTGGCGCAGTTGATATGTCAAACAGGTTTCTAGAGCACAGCT AACACCAGTCGTCCCTATCTGCTGCCCTAGGTCTATGAGTGGTTGCTGGATAACTTTACGGGCATGCAT AAGGCTCGTATATATATTCAGGAGACCACAACCGTTTCCCTCTACAAATAATTTTGTTTAACTTTTAC TAGAGCTAGCAGTATATACGACTCACTATAGGGGTCTCATCTCGTGAGATAGGCGAGATACGAACTT TAAGAGGAGATATACCA |
| SEQ ID NO: 84 | GTTTGAGAGATATGTAAATTCAAAGGATAATCAAAC |
| SEQ ID NO: 85 | actacattttttaagacctaattttgagt |
| SEQ ID NO: 86 | ctcaaactcattcgaatctctactctttgtagat |
| SEQ ID NO: 87 | CTCTAGCAGGCCTGCAAATTTCTACTGTTGTAGAT |
| SEQ ID NO: 88 | CCGTCTAAAACTCATTCAGAATTTCTACTAGTGTAGAT |
| SEQ ID NO: 89 | GTCTAGGTACTCTCTTTAATTTCTACTATTGT |
| SEQ ID NO: 90 | gttaagttatatagaataattctactgttgtaga |
| SEQ ID NO: 91 | gtttaaaaccacttttaaaattctactattgta |
| SEQ ID NO: 92 | GTTTGAGAATGATGTAAAATGTAACAGAAATGTTTAATACCATATTTTTACATCACTCTCAA ACATATCATCTCTTGTTACTGTTATCGTATCCAGATTAAATTTCACGTTTTT |
| SEQ ID NO: 93 | CTCTACAACTGATAAAGAATTTCTACTTTTGTAGAT |
| SEQ ID NO: 94 | GTCTGGCCCAAATTTTAATTTCTACTGTTGTAGAT |
| SEQ ID NO: 95 | GTCAAAAGACCTTTTTAATTTCTACTCTGTAGAT |
| SEQ ID NO: 96 | GTCTAGAGGACAGAATTTTCAACGGGTGCTGCCAATGGCCACTTTCCAGTGGCAAAGCCCGTTGAGCT TCTACGGAAGTGGCAC |
| SEQ ID NO: 97 | CGAGGTTCTGTCTTTTGGTCAGGACAACCGTCTAGCTATAAGTGCTGCAGGGGTGTGAGAAACTCCTATT GCTGACGATGTCTCTTTTAACGAGGCATTAGCAC |

TABLE 6-continued

SEQUENCE LISTING

| SEQ ID NO: | Sequence |
|---|---|
| SEQ ID NO: 98 | GAACGAGGGACGTTTTGTCTCCAATGATTTTGCTATGACGACCTCGAACTGTGCCTTCAAGTCTGAGGCG AAAAAGAAATGGAAAAAAGTGTCTCATCGCTCTACCTCGTAGTTAGAGG |
| SEQ ID NO: 99 | AATTACTGATGTTGTGATGAAGG |
| SEQ ID NO: 100 | TATACCATAAGGATTAAAGACT |
| SEQ ID NO: 101 | GTCTTACTCTCCACCTTTCCACCTG |
| SEQ ID NO: 102 | ATTTGAAGGTATCTCCGATAAGTAAAACGCATCAAAG |
| SEQ ID NO: 103 | GTTTGAAGATATCTCCGATAAATAAGAAGCATCAAAG |
| SEQ ID NO: 104 | TTGTTTTAAATACCATATTTTTACATCACTCTCAAAC |
| SEQ ID NO: 105 | AAAGAACGCTCGCTCAGTGTTCTGACCTTTCGAGCGCCTGTTCAGGGCGAAAACCCTGGGAGGCGCTCG AATCATAGGTGGGACAAGGGATTCGCGGCGAAAA |
| SEQ ID NO: 106 | GTTTGAGAATGATGTAAAAATGATGGTACACAGAAATGTTTAATACCATATTTTACATCACTCTCAA ACATACATCTCCTTGTTACTGTTTATCGTATCCAGATTAAATTTCACGTTTTT |
| SEQ ID NO: 107 | GTCTAGAGGACAGAATTTTTCAACGGTGTGCCAATGGCCACTTTCCAGGTGGCCAAAGCCCGTTGAGCT TCTACGGAAGTGGCAC |
| SEQ ID NO: 108 | MSIYQEFVNKYSLSKTLRFELIPQGKTLENIKARGLILDDEKRAKDYKKAKQIIDKYHQFFIEEILSSVC ISEDLLQNYSDVYFKLKKSDDDNLQKDFKSAKDTIKKQISEYIKDSEKFKNLFNQNLIDAKKGQESDLIL WLKQSKDNGIELFKANSDITIDEALEIIKSFKGWTTYFKGFHENRKNVYSSNDIPTSIIYRIVDDNLPK FLENKAKYESLKDKAPEAINYEQIKKDLAELTFDIDYKTSEVNQRVFSLDEVFEIANFNNYLNQSGITK FNTIIGGKFVNGENTKRKGINEYINLYSQOINDKTLKKYKMSVLFKQILSDTESKSFVIDKLEDDSDVVT TMQSFYEQIAAFKTVEEKSIKETLSLLFDDLKAQKLDLSKIYFKNDKSLTDLSQQVFDDYSVIGTAVLEY ITQQIAPKNLDNPSKKEQELIAKKTEKAKYLSLETIKLALEEFNKHRDIDKQCRFPEEILANFAAIPMIFD EIAQNKDNLAQISIKYQNQGKKDLLQASAEDDVKAIKDLLDQTNNLLHKLKIFHISQSEDKANILDKDEH FYLVFEECYFPELANIVPLYNKIRNYITQKPYSDEKFKLNFPENSTLANGWDKNKEPDNTAILFIKDDKYL GVMNKKNNKIFDDKAIKENKGEGYKKIVYKLLPGANKMLPKVFFSAKSIKFYNPSEDIIRIRNHSHTKN GSPOKGYEKPEFNIEDCRKFIDFYKQSISKHPEWKDFGFRFSDTQRYNSIDEFYREVENQGYKLTFENIS ESYIDSVVNQGKLYLFQIYNKDFSAYSKGRPNLHTLYWKALFPDERNLQDVVYKLNGEAELFYRKQSIPKK ITHPAKEAIANKNKDNPKKESVFEYDLIKDKRFTEDKFPFHCPITINFKSSGANKFNDEINLLKEKAND VHILSIDRGERHLAYYTLVDGKGNIIKQDTFNIIGNDRMKTNYHDKLAAIEKDRDSARKDWKKINNIKEM KEGYLSQVVHEIAKLVIEYNAIVVPEDLNFGFKRGRFKVEKQVYQKLERMLIEKLNYLVFKDNEFDKTGG VLRAYQLTAPFETFKKMGKQTGIIYYVPAGFTSKICPVTGFVNQLYPKYEsVSKSQEFFSKFDKICYNLD KGYFEFSFDYKNFGDKAAKGKWTIASFGSRLINFRNSDKNHMWDTREVPTKELEKLLKDYSIEYGHGEC IKAAICGESDKKFFAKLTSVLNTIIQMRNSKTGTELDYLISPVADVNGNFFDSRQAPKNMPQDADANGAY HIGLKGLMLLGRIKNNQEGKKLNLVIKNEEYFEFVQNRNN |
| SEQ ID NO: 109 | MSIYQEFVNKYSLSKTLRFELIPQGKTLENIKARGLILDDEKRAKDYKKAKQIIDKYHQFFIEEILSSVC ISEDLLQNYSDVYFKLKKSDDDNLQKDFKSAKDTIKKQISEYIKDSEKFKNLFNQNLIDAKKGQESDLIL WLKQSKDNGIELFKANSDITIDDEALEIIKSFKGWTTYFPKGFHENRKNVYSSDDIPTSIIYRIVDDNLPK FLENKAKYESLKDKAPEAINYEQIKKDLAELTFDIDYKTSEVNQRVFSLDEVFEIANFNNYLNQSGITK |

TABLE 6-continued

SEQUENCE LISTING

| SEQ ID NO: | Sequence |
|---|---|
| | FNTIIGGKFVNGENTKRKGINEYINLYSQQINDKTLKKYKMSVLFKQILSDTESKSFVIDKLEDDSDVVT<br>TMQSFYEQIAAFKTVEEKSIKETLSLLFPDLKAQKLDLSKIYFKNDKSLTDLSQQVFDDYSVICTAVLEY<br>ITQQVAPKNLDNPSKKEQDLIAKKTEKAKYLSLETIKLALEEFNKCHRDIDKQCRFEEILANFAAIPMIFD<br>EIAQNKDNLAQISLKYQNQGKKDLLQASAEEDVKAIKDLLDQTNNLLHRLKIFHISQSEDKANILDKDEH<br>FYLVFEECYFELANIVPLYNKIRNYITQKPYSDEKFKLNFENSTLANGWDKNKEPDNTAILFIKDDKYYL<br>GVMNKKNNKIFDDKAIKENKGEGYKKIVYKLLPGANKMLPKVFFSAKSIKFYNPSEDIILRIRNHSTHTKN<br>GNPQKGYEKPEFNIEDCRKFIDFYKESISKHPEWKDFGFRFSDTQRYNSIDEFYREVENQGYKLTFENIS<br>ESYIDSVVNQGKLYLFQIYNKDFSAYSKGRPNLHTLYWKALFDERNLQDVVYKLNGEAELFYRKQSIPKK<br>ITHPAKEAIANKNKDNPKKESVFEYDLIKDKRFTEDKFFHCPITTNFKSSGANKFNDEINLLLKEKAND<br>VHILSIDRGERHLAYYTLVDGKGNIIKQDTFNIIGNDRMKTNYHDKLAAIEKDRDSARKDWKKINNIKEM<br>KEGYLSQVVHEIAKLVIEHNAIVVPEITKRGRFKVEKQVYQKLEKMLIEKLNYLVFKDNEFDKTGG<br>VLRAYQLTAPFETFKKMGKQTGIIYYVPAGFTSKICPVTGFVNQLYPKYESVSKSQEFFSKFDKICYNLD<br>KGYFEFSFDYKNFGDKAAKGKWTIASFGSRLINFENSDKNHNWDTREVYPTKELEKLLKDYSIEYGHGEC<br>IKAAICGESDKKFFAKLTSVLNTILQMRNSKTGTELDYLISPVADVNGNFFDSRQAPKNMPQDADANGAY<br>HIGLKGLMLLDRIKNNQEGKKLNLVIKNEEYFEFVQNRNN |
| SEQ ID NO: 110 | MDKKYSIGLDIGTNSVGWAVITDEYKVPSKKFKVLGNTDRHSIKKNLIGALLFDSGETAEAATRLKRTARRY<br>TRRKNRICYLQEIFSNEMAKVDDSFFHRLEESFLVEEDKKHERHPIFGNIVDEVAYHEKYPTIYHLRKKLVDST<br>DKADLRLIYLALAHMIKFRGHFLIEGDLNPDNSDVDKLFIQLVQTYNQLFEENPINASGVDAKAILSARLSKSR<br>RLENLIAQLPGEKKNGLFGNLIALSLGLTPNFKSNFDLAEDAKLQLSKDTYDDDLDNLLAQIGDQYADLFLA<br>AKNLSDAILLSDILRVNTEITKAPLSASMIKRYDEHHQDLTLLKALVRQQLPEKYKEIFFDQSKNGYAGYIDG<br>GASQEEFYKFIKPILLEKMDGTEELLVKLNREDLLRKQRITFDNGSIPHQIHLGELHAILRRQEDFYPFLKDNREK<br>IEKILTFRIPYYVGPLARGNSRFAWTRKSEETITPWNFEEVVDKGASAQSFIERMTNFPDKNLPNEKVLPKHSL<br>LYEYFTVYNELTKVKYVTEGMRKPAFLSGEQKKAIVDLLFKTNRKVTVKQLKEDYFKKIECFDSVEISGVED<br>RFNASLGTYHDLLKIIKDKDFLDNEENEDILEDIVLTLTLFEDREMIEERLKTYAHLFDDKVMQLKRRRYTG<br>WGRLSRKLINGIRDKQSGKTILDFLKSDGFANRNFMQLIHDDSLTFKEDIQKAQVSGQGDSLHEHIANLAGSP<br>AIKKGILQTVKVDELVKVMGRHKPENIVIEMARENQTTQKGQKNSRERMKRIEEGIKELGSQILKEHPVENT<br>QLQNEKLYLYYLQNGRDMYVDQELDINRLSDYDHIVPQSFLKDDSIDNKVLTRSDKNRGKSDNVPSEEV<br>VKKMKNYWRQLLNAKLITQRKFFDNLTKAERGGLSELDKAGFIKRQLVETRQITKHVAQILDSRMNTKYDEN<br>DKLIREVKVITLKSKLVSDFRKDFQFYKVREINNYHHADAYLNAVVGTALIKYPKLSEFVYGDYKYDV<br>RKMIAKSEQEIGKATAKYFFYSNIMNFFKTEITLANGEIRKRPLIETNGETGEIVWDKGRDFATVRKVLSMPQ<br>VNIVKKTEVQTGGFSKESILPKRNSDKLIARKKDWDPKKYGGPDSPTVAYSVLVVAKVEKGKSKKLKSVKEL<br>LGITIMERSSFEKNPIDFLEAKGYKEVKKDLIIKLPKYSLFELENGRKRMLASAGELQKGNELALPSKVVNFLY<br>LASHYEKLKGSPEDNEQKQLFVEQHKHYLDEIIREQISEFSKRVILADANLDKVLSAYNKHRDKPIREQAENIIH<br>LFTLTNLGAPAAFKYFDTTIDRKRYTSTKEVLDATLIHQSITGLYETRIDLSQLGGD |
| SEQ ID NO: 111 | PKKKRKV |
| SEQ ID NO: 112 | KRPAATKKAGQAKKKK |
| SEQ ID NO: 113 | PAAKRVKLD |
| SEQ ID NO: 114 | RQRRNELKRSP |
| SEQ ID NO: 115 | NQSSNFGPMKGGNFGGRSSSGPYGGGGQYFAKPRNQGGY |
| SEQ ID NO: 116 | RMRIZFKNKGKDTAELRRRRVEVSVELRKAKKDEQILKRNV |
| SEQ ID NO: 117 | VSRKRPRP |

TABLE 6-continued

SEQUENCE LISTING

| SEQ ID NO: | Sequence |
|---|---|
| SEQ ID NO: 118 | PPKKARED |
| SEQ ID NO: 119 | PQPKKKPL |
| SEQ ID NO: 120 | SALIKKKKJVIAP |
| SEQ ID NO: 121 | DRLRR |
| SEQ ID NO: 122 | PKQKKRK |
| SEQ ID NO: 123 | RKLKKKIKKL |
| SEQ ID NO: 124 | REKKKFLKRR |
| SEQ ID NO: 125 | KRKGDEVDGVDEVAKKKSKK |
| SEQ ID NO: 126 | RKCLQAGMNLEARKTKK |
| SEQ ID NO: 127 | ATGGGTAAGATGTATTATCTGGGTTTGGATATAGGCACTAACTCTGTGGGATATGCAGTAACTGATCCCT<br>CGTATCACTTGTTAAAGTTCAAAGGCGAACCATGTGGGAGCCACATGTATTGCTCGCGGTAATCAGA<br>GTGCCGAAAGGCGATCTTTCAGAACATCCAGGAGCGATTAGATAGGACGCAAAGAGTAAAGCTT<br>GTGCAAGAGATCTTTGCTCCTGTCATTTCACCCTATAGACCCTCGTTTTTATAAGAATTGCACGAATCGGC<br>TCTATGGAGAGACGATGTTGCCGAAACAGATAAACATATCTTTTCAATGATCCCACTTATACAGACAA<br>GGAATACTACCTCCGACTACCCGACAATTCATCATTTGATCGTCGATCTTATGGAGAGCTCTGAAAAGCAT<br>GACCCCCGACTTGTCTATTGGCTGTAGCTTGGTTAGTTGCTCATAGAGCTCATTTCTGAATGAAGTAG<br>ATAAAGACAATATAGGTGATGTACTTCTTTGAAGAGCCCTTCAAGCTACTCTGCTGTCTAGGAATAGCGTCA<br>AATGGCGTCAGTCCCTGGGTCTGTGAGTCGAAGGCCTCATAATTCGGATCGCAAAAACCGGAAGATAACTTTGACGCTA<br>ACGACAAATATAAAGCATTAAAATCGCTGATATTCGCGGTAAGAAGTAAAGTAAACAAACTATTCCAC<br>ACATCTCTGAAGATGGTTTAATCCAATTGCTAGCTTTTACGTTGAATGATAAAGCACGTTAAAGTAACAATTCTAGCTACTT<br>AAGAGTCCAACGATGCTAGCTTTACGTTGAATGATAAAGCACGCTATTGAAGCAGTAAACAAATTCTAGCTACTT<br>TAACGCCTGACGAGTGCGAATGGACCGATATCGCTCATATCGCAGATTGTTCGATTGGGCCATACGAACACG<br>CGCTAAAGGATGGCAGGACGATATCGCTCATATCGCAGATTGTTCGATTGGGCCATACGAGACACG<br>CTCAGTTAAAGTACTTTGTGAAGACCTACCTAGCTAAAGATGTATGATATCTCAGAAACGTAGACTC<br>CGAGACAACTAAAAATATGTAGCTTATTCTTACCATGTGAAGAAGTGAAAGGCACATTACCAAAAAA<br>TAAAGCAACGAAGATTGATTTGTAAAATACGTCCTTGGCAAAGTCAAAAACATTGAAATGTTCCGAAGC<br>AGACAAGGTTGATTTTGATGAAATGATACAACGACTTACCGGACAATCTCTTTTATCCAAAGCAAGCTC<br>AGGTGAAAATAGAGTAATACCATACCAGTTGTACTACTATAGCGTAAAGATGCTATTTCTAACCAGACAATTTAAACAAAGCCGC<br>CTCATATCTACCTTTTTTGACACAATGCGTAACAAGATAATTCCAAGCACAATAAATTACTGTCTATA<br>ATGACATTTCGCATACCATATTTCGTCGCCGTTAAGGAAGATAATTCAAGAAGATGCCTGGTTGGAAC<br>GTAAAGCGGGTAAAATTACCCGTGGAACTTTAATGATAAAGTAGATCTTGATAAATCGGAGGAAGCCT<br>TTATCCGTAGGATGACCAATACTTGCACGTATTACCCAGGAGAAGACGTGTTACCATTAGATTCACTTAT<br>GTGAAACAACAAGTTTATGATCGACCAAGATATTGGTTTAAGGATTAACAGTTAACGGATAACAGTAACAATCTA<br>CTATTATCTCTTGGACGTTGGATATAAACACGGTAAGCTGACTGGTATTGACCAGAGATGATGTGAAAGAA<br>ATAACACTTATCATCATTTTAAATCTTCAACGCATATCTAAGGACTCAGAAAACACGATTCGGCCGTTTGTCTAAAAT<br>TAGTGGAAAGAATGAATACATATCTGACGATCTAAGGACGTCAGAAGAGGTCAGACTGTGTTAATAATTATGAA<br>CTCTAACAGCTGACGATGTTAAGCATATCTAAGGACTCAAGGAGAGACAGGGCGAGAGACAGGCAAGAGCAAGTATACTGATTTTATGTG<br>GTTTTTGACAGGATTGAAGTGTTCATAAGGACGAAAGTGTTCATAAGGGCAAGAGCAAGTATACTGATTTTATGTG |

TABLE 6-continued

SEQUENCE LISTING

| SEQ ID NO: | Sequence |
|---|---|
| | GAATACTAACGACAATTTAATGCAACTACTGTCCGAATGTTACACATTCTCGGATGAGATCACCAAATTA<br>CAAGAGGCCTACTACGCAAAAGCTCAATTATCGCTAAATGACTTCTTGGACTCTATGTATATCAAACG<br>CCGTTAAGAGACCTATTTCATCGAGATGGCCGAGATGGAGAGTCTAAGAGAAGGCATGCGGGACGCAC<br>CTAAAGAGAATTTCATCGAGATGGCCGAGATGGAGAGTCTAAGAGAAGAAAGATCTGTGACTCGTAGA<br>GAGCAAATTAAAAATCTTATAGATCAATTCGTAAAGACTTTCAACAAGAAGTTGATTTTCTGAAAAG<br>ATATTGGAAAAATAAGAGTGACGGCAGCTTCAGTCGACGCTTTATATTTCACAATTAGGCA<br>GAGACATGTACACAGGTGATCCAATCAAATTGACAACATATTAAAGACACATTTTACACAATGATC<br>ATATTTATCCTCAATCGATGGTGAAAGATGACAGTTTGATAACAAGGTACTAGTCAAAGCGAAATCA<br>ATGCGAAAAGAGTTCGCGCTATCCATTAGACAGCATTAGACAAATCAAAATGAAGCCGTTGTGGGATG<br>CCTACTATAATCATGGATTAATTTCTTAAGAAATATCCAGCGTTTGACGAGATCTACTCCATTTACGGA<br>CGACGAAGTGGGATTTTATCAATCGTCAGTAGTAGAAATGCTACAAAGCTCTACTAAAGCTTTAGCAAT<br>ATTGTTAAAGCTAAGTTTCCAGATACTGAAATAGTTTACTCAAAGGCTGACTATCCAGCGATTTTAGA<br>CATGAATTCGGCCTGGTTAAGAGTAGGAATATTTAATGATCTACACCATGCTAAAGATGCCTTTCTCGCAA<br>TAGTTACTGGGAACCTTTATCATGGAAGATTTAATAGAAGATGGTTTATGGTTAACCAGCCATACTCGT<br>GAAAACTAAGACATTGTTTACCCATTCAATTCAAATTAAGATTTGTCGCTTGGAATGAGAAGAAGA<br>TCTTGGACGTATCGTAAAGATGTGAAACATACAAAACAAGAACACAATTCCACTTCACCAGTTTCCTTGAT<br>AGGAGGAGGGATTGTTCGATATTCAACCTCAAAGCTTCTACCGGATTGGTCCACAAAGCAGGG<br>TTGGATGTGTTAAATATGGAGGATACCGATAAAAGCCACTGCCGCCGCTATATTATTAGTACGTTTACAC<br>TCGAGGATAAGAAGACTCAACACAATGATGAATCTGTTGAAGGTCTCTACAAAGCACGTATTG<br>ACCATGATAAAGAGTTTTAACAGATTATGCTCAGACCACGAGACATATCAAACTGAATTCGATGATTCTATTGA<br>AGAAAGTGATCAACATCATGTTCCCTATGGTGTGGGAAGAGTAGCAAAGGTAAGTCAGTACTAGTCATGCTATGGTGCCA<br>TGGAATTCTATCTTTCTATTGGTGGGAAGAGTAGCAAAGGTAAGTCAGTACTAGTCATGCTATGGTGCCA<br>TTAATCGTCCCCACCAAGATAGAATCTATATCAAGGCTATGGAGAATCGTTTGCAAGAAATTCAAAGAA<br>AATAATAAATTGAGGATCGTTGAAACATATAACCCATATAATAAATTTCTCTACCACAATTGAACTTATCGAG<br>CTTTTTCTACAAAGTGTCATTCACCAAATTGTCTCCAAGAAGTCCAGACTTACTTAATTACTAGTA<br>ACGGTAGAAGTACATTCACCAAATTGTCTCCAAGAGGAGCAAGTCCAGACTTACTTAATTAACTAGTA<br>TATTAAAACTTGTCGTTCTTCTGGCTGTGATTTAAAATCAATAAAAGTATCAGATATTAGTTGAGCAAGCGCA<br>TATGATATCCGCTGATTTAACTGCTTAATCAAAAAAGTATTCAGATATTAGTTGAGCAAGCGCA<br>TCAGGTCTATTTGTTTCAAAATCTTGGAATACTCTTGCCAAAAAAGAAGAAAGTTTAG |
| SEQ ID NO: 128 | ATGAGTAGTTAACAAAGTTTAACCAATAATAGTAAGCAACTAACTATAAAGAACGAATTGATACCG<br>GTCGGTAAGACTTTGGAAAACAATAAGAAAATGGGTTGATTGATGGAGACGAGCAATTGAATGAGAA<br>TTATCAAAAGCAAAGATAATAGTAGATGATTTTTTGAGAGACTTTATTAATAAGCTCTAAATAACACT<br>CAAATTGGTAACTGGAGAGCTAGCCGACGCCTTGAACAAGGAAGATAGGAGATAATATTGAGAAATT<br>ACAAGATAAGATTAGAGGGATTATCGTCTAAGTTGAGACTTTTGATCTGTTCAGTTCGTATTCGATT<br>AAAAAGACGAGAAAATCATCGATGATGAAGATAAGATGGAGAAGAGGAGCTAGACCTTGGGAAGAA<br>GACATCTAGCTTCAAATACAATATTCAAGAGAAATTGTTCAAACTTTGTCCTTCCTTCATATTTAAAACA<br>ACAAATCAAGATAAGTTAAAAATATTCACTAAAATGCCTATATCTACCTTCATAGCTTATAGAATTGTTCACGATAAT<br>AAACAGGAAAAATTTCTAGATATATCAAGGTGTTTAATGTTTGGCAAACCGAGTGTCTCAGTAATAGTCA<br>AGGCCGACAACTACCTTAAAAGCAAGAATGTGATTGCAAAAGATAAGTCTTGGCTAACTATTTACAG<br>TCGGTGCCATGATTATTTTCTGAGTCAAGAAGATTCAGGGTTGAACAGGGTTATCAATCAAGAATGTCAAAAGATTC<br>AGCTTTTGCCGGGATCGAGAAGATTCAGGGTTGAACAGGGTTATCAATCAAGAATGTCAAAAGATTC<br>TGAATTAAGTCTAAGCTACAAGCAATGCAAAGAATAGGAATGCCAGTCTTATTCAAACAATCCTTTCA<br>GACAGAAAAGTCATTTGTGATTGACGAGTTCGAATCAGACGCTCAGGTAATTGATGCTGTTAAAAT<br>TTTTACGCCGAACAATGCAAAGATAATAACGTCATATTTAATTTGAATCGATCAAGAATATTGCTT<br>TTTTGTCGGATGATGAGTTAGACGCGAATTTCATAGAGGTAAATACCTGTCCTCTGTCTCAAAAATT<br>GTATAGTGATTGGTCAAGTTGAGAAGTTACAAGGTTGAAAGGTCAAACAGGGTAACAAGA<br>ATTAGCGAAGAAAATCAAAACTAACAGGCTATAAGGCTATAAGTAAGTACGAGTTCAGTTT |

TABLE 6-continued

SEQUENCE LISTING

| SEQ ID NO: | Sequence |
|---|---|
| | ATCTGAACTAAATTCAATTGTTCATGATAACACAAAATTTTCCGATCTTTATCATGCACATTACATAAA |
| | GTTGCAAGTCAAGAAATTAGTCAAAGTAACGAAGTGATTGGCCAAAACATCTAAAAAACAACGAGGA |
| | AAAACAGAAGAGATAAAAGAACCTCTGAAACGTTTATGCGACTACGATCCGTCCATTAATAATTAACTGT |
| | AAAAGTTTTAACAAAAAATGTAATTTCTATGTCGACTACGATCGCTGCATTAATGAGTTGTCCAGTGTTG |
| | TGTACTTGTATAATAAAACTCGTAATTATTGTACGAAAAGCCGTACAACACTGACAATTTAAGTTGA |
| | ATTTCAACTCCCCCACAACTGGGTGAGGGCTTCTAAAAGTAAAGAGAATGATTGCCTTACATTATTATT |
| | TAAAAAAGATGATAATTATTATGTCGAAGATCATAAGAAAGGGGCAAAGATCAACTTCGATGACACTCA |
| | GGCCATAGCAGACAACACAGATAACTGTATATCAAAATGAATTATTTTTTGCTGAAGGATGCTAAAAA |
| | ATTTATCCCCAAATGTTCAATACAATTAAAGAGAGTTAAGGCCCATTTCAAAAAGTCGGAAGATGACTA |
| | TATTTTGTCCGATAAGGAAAAATTCGCTAGTCGCTTGTTATTAAAAATCCACATTTCTTCTCGCTACG |
| | GCTCATGTGAAAGAAGAGGGCAATATATAAGAAATTTCAGAAGAAATACTCCAAAGAAAATCCTAC |
| | GGAGTATAGAAATAGTCTGAACGAATGGATAGCATTCTGCAAAGATACCTTCTTGAAGACCTATAAAGCTGC |
| | CACCATCTTTGATATTACAACTTGAAAAGGCCGAGGAATACCGCTGACATTGTGAATTCTATAAGA |
| | TGTAGATAATCTTTGTTACAGTTAGAATTTGCCCTATCAAAACTTCTTTATCGAAAATCTTATAGATA |
| | ATGGCGATTTATACCTGTTTAGAATAATAACAAGGACTTTTCTCAAAAAGTACAGGCCACGAAAAACTT |
| | ACACACATTACTTGCAGGCTATATTTGACGAGCGAAACTTAAACACAACCCCACGATAATGTTGAATGG |
| | AGGTGCAGAGTTATTCTACGAGAATCTATAGAACAATCTAGAACAAGTGTACAAGTCTAGATGACAAAATCCGTAACAAAGCCGGTA |
| | AGTATTTAGTGAATAAAGTGTGCAAAGATGTGCAAGTCTAGATGTACAAGTCTAGATGACAAAATCCGTAACGTTATTACC |
| | AGTATGAAAACAAATTCAATTGATACTCTTTCGGACGAAGCTAAAAAAGGTTCTGCCAAACGTATTAAGA |
| | AAGAGGCTACGCATGATATATAACAAAGATAAACGTTTCACTAGCGACAAATTCTTCTTTCATTGTCCTTT |
| | AACAATCAACTACAAGGAAGGTGACACCAAACAATTTAATAATGAAGTGCTCTCATTCCTTAGAGGTAA |
| | CCCCGATATCAATATTATCGGCATTGATAGAGGAGAAAGAAACCTAATCTATGTAACAGTCATTAACCA |
| | AAAAGGCGAATATTGGATAGCGTCTCCTTCAATACTGTCCAATAAGTCATCGAAGATAGAACAAAAAC |
| | TGTTGATTACGAAGAAAAATTGGCCGTTGAAGCGTATCGAAGCGAAGAGATCTTGGGATA |
| | GCATATCCAAGATTGCCACCTTGAAGGAGGGTTATCTAAGCGCGATCGTACATGAAATCTGCTTATTAAT |
| | GATTAAGCATAAATGCTATTGCTGTGTTAGAAAACCTGAATGCCGTTTTAAAGGATTAGAGGTGGTTTG |
| | TCAGAAAAGTCAGTATGAATAAACCGTCAGGTTGCTCAATGGTCTTCAGTTAAGTGATCAATTGAGTCTT |
| | AAAGAAAAGTCAGTATGAATAAACCGTCAGGTTGCTCAATGGTCTTCAGTTAAGTGATCAATTGAGTCTT |
| | TCGAAAAATTAGGAATTCAAAGTGGATTCATTTTTATGTACCAGCCGCGTACACTTCCAAAATTGACCC |
| | TACGACCGGATTTGCCAACTCTTATTCCAAAAGAAGCCTTTTCAAGTTTCTTTTGACCTAGACTCGTT |
| | ATCGAGAAAGGATTTTCATCTTTCGAAGATGATTTAGCAAGTCCAAGTGGAATGTATACACATTCGGCGA |
| | GAGAATTATCAAGCCCAAGAACAAACAAGGCTATAGAGGAACAAGAAGAATCAACTTGACTTTTGAGA |
| | TGAAAAATTACTCAAGCGATAACAAAGGTTTCATTTGATTTGGAGAACAACTTGATTCCCAATTTGACATC |
| | AGCTAACTTGAAGGATACGTTCTGGAAGAGTTATTCTTTATATTCAAAACGACATTACAACTGCGTAAT |
| | AGTGTTACAACGGTAAAGAGATGTATTAATCTCACCTGTAAAGAATGCCAAAGGAGAATTTTTCGTA |
| | TCCGGTACTCACAATAAGACACTACCACAGATTGCGCGAAGAAAAAGACACCAAGAAGATCATGGCTATT |
| | GGATTAATGATACTTGAAAGAAAATAACCTTGTTGCGCAAAGAGGAGAGGTGTTTTGTAA |
| | AGCAATGTGATTGGTTTGAATACCTGCAAAGAGGAGAGGTGTTTTGTAA |
| SEQ ID NO: 129 | ATGAACAATTATGACGAGTTCACAAGCTATACCCTATCCAAAAAAACTATCAGGTTCGAATTGAACCA |
| | CAAGGGAGAACAATGGAACATCTGGAGACATTCAACTTTTTTGAAGAGACAGAGACAGGCGAAGAA |
| | ATACAAAATTTAAAAGAGGCCATCGATGAATATCTCAAAAAAGTTTATCGACGAGCATTAACAACAT |
| | GTCTTTGGACTGGAATTCACTAAACAAATTTCTGAGAAATATATAAGTCTCGGGAGGAAAAAGACAA |
| | AAAGTCTTTTGTCCGAGCAAGAAGATGAGACAAGAAATTGTCTCGGAGTTAAAAAGATGATCG |
| | GTTCAAAGATTTGTTTAGCGAAGAGATGCTTTGAAATCGTTTGACAAGTTCAGCCGTTACTTCATTGGTTTTACATGAAAT |
| | CCATCAAGAAATAGATGCTTTGAAATCGTTTGACAAGTTCAGCCGTTACTTCATTGGTTTTACATGAAAT |
| | AGGAAGAACATGTATAGCCGCGGCGATGAATCACCGCTTATACCGGCTATATCGAATAGAATCGTTAACGAAAATTT |
| | CCGAAATTTTTGGATAATTTTGCAAAAATACCAGGAAGCTAGGAAGTACCCTGAATGATATAAAG |

TABLE 6-continued

SEQUENCE LISTING

| SEQ ID NO: | Sequence |
|---|---|
| | GCGGAATCAGCTTTGGTGGCTCACAACATAAAGATGGATGAAGTCTTCTCGCTGAATATTTAACAAA
GTATTAAATCAGGAGGAATCCAAAGATACAACTAGCCTTGGGTGGAATACGTAACCAAATCAGGTGAG
AAAATGATGGCTTAAATGCACTTAAATCTAGTCACCAATCCGAAAAGTCCTCTAAAGGAGGATA
CACATGACACCATTGTTAAGCAAATCCTTTCGAGAAAGAATCTTTTCATATATCCCCGATGTTTCA
CTGAGGATAGTCAATTGTTGCCCCAGCATTGGTGATTTTTGCACAAATAGAAAATGATAAAGATGGTA
ACATCTTCGATAGAGCCTTGGAATTGATAAGCTCCTATGCAGAATACGAACGAATACATTA
GACAAGCTGACATCAACAGAGTAAGCAACGTTATTTTGTGAGTGGGAACTTTAGGTGATTAATGC
GGGAGTACAAAGCTGACTCAATCAATGATATTAATTGGAACGTACGTGCAAAAAGTCGATAAGTGGC
TTGATAGTAAGGAGTTTGCTCTGTCGGATGTACTAGAAGACAATTAAAGAGACGCCGCACGTAAGGAAATGCAT
TTAATGAATATATTAGTAAAATGAGGACGCGTCTAGAAGAAAAGATAGACGCCGCACGTAAGGAAATGAAG
TTTATTCCGAGAAAATATCTGGCGATGAAGAGTCAATTCACATATCACTCGATTCTGTTC
AGCAATTCTCCATTTTTTAACCTTCTCAAGCAAGACATTCCCTTAGATGGGGCTTTTTATGCC
GAATTTGATGAAGTTCATTCAAAGTTGTTGCTATTGTTCCTCTTTACAATAAGGTCCGTAATTACCTTAC
TAAAAATAACTTGAACACCAAGAAAATAAAGTTAAACTTCAAGAATCCGACTCTTGCCAACGGGTGGGA
TCAGAATAAAGTTTATGATTATGCGACCTTAATATTCTAAGAGATGGAATTATACTTAGGAATCATC
AATCCAAAGCGTAAGACAAATACCAAGGACCTAACACAAGAACTTGCCTCGCGTATTTTAACTTCAACAAGGGTAA
GGTGTATAAGCAATAACCAAGGACCTAACACAAGAACTTGAAGGTTACGAAGCAGAATAAACATCAGAGGTGATA
AGTTCGATCTGGATTTCTGCCATAATATCTGATTGACTTTTTTAAGGAATCTATAGAAAAACATAAGGACTG
GTCCCAAATTAATTCTACTTCTCACCTACAGAATATTCTCAGCCGGAAAAAGTTATGGTGCAATTTTATTAGACGTTG
AGAAACAAGGATATAGGATGCATTTGAAATTCACAATAAAGACTTCGTTAAGACTCGCAACCTGCAACGAAGAAGATATGC
GGTGATTTATTCTTGTTCCAAATTTACAATAAAGACTTCGTTAAGACTCGCAACCTGCAACGAAGAAGATATGC
ATACCATATATTGGAACGCTGCCATCTCCGCCAAGAACATTACGAACAGTCGTCGTAAAGCTTAATGAG
AAGCTGAGCTGTTCTATAGAGACAAGAGTGATATAACCCGTTCAGACAAAATCATAAAAAAACTGACCGATTATCATA
TGAACAGAACTTACAATGGTCGTACACCCGTTCAGACAAGAATACCTCAGATATTTCAAGGGCACACT
ATGGTAGGACAAAAGGACTTGGGCGAGGCCAAGGAGTAGAGTATTTAAACGATAAAGTAGATATTCAAGGGCACACT
ATGATATTACGAAAGACAGGAGATATTTAAACGATAAAGTAACTTACTCCTGCCCTTGACCTTAACTT
TAAAGCTAATGGTAAAAAGAATTTGAACAAGAAATTTACTTGAACAAGTTTTATCGGACGAAAAGCTCA
CATAATCGGAATCGACCGGAGAGAATTTGAACGTCATTGATGGTTGACTATCGGAAAATTTAAAATTCAAGAGGTGAAGAT
TATTGATCAGCAATCTTTGACGAGATAACCAAATCCTATTGGTTTGACTATCGGAAAATTAAATCAAGGAGGGAAAT
ATCAAAAGCTGTACACGAGATAACTAAAATGGCTATCCAATATATCAATTATGCTAATATTGTGTAATGAAGAATT
GAATTAGTTTTAAACGCGCAGAGATCAATCATGGATGCCAGGTTTAAAGTCGAAAAACAAATATACCAAAAGTTGAAACATGTT
AATTGATAAGATGACAATCTCTGTTTTGCAAAGATGCACCTGATGAGAGTCCTGGCGGTGCTGAACGCC
TATCAATTAACAACCATTAAGCTCCTTTTGCTAAACTGGGTAAACAAACTGGCATTCTATTTATGTTC
CAGCCGCTTACACCTCAAAGATCGACCCGGTTGTGAAACTTATATTATTTAATAATAACTTCTTCCAAAAC
AAACCGCAAGAACCCAAGAATTCCTACACAAGAATTTGAATCAATATCCTATAGCCAAAAGATGGAG
GTATATTCGCTTTGCCTTTGACTACAGAAAAGTTTGGCACTTCCAAGACAGATCATAAAAATGTGTGGAC
CGCTTATACCAACGGAGAAAGATGCGTATATTATAAAGAAAAAAAGAGGAACGAACTATTTGATCCATC
GAAAGAAAATTAAAGAAGCTTTGACAGCAGCGGAATCAATAATGAAGAGAGATCAAACATATACTTCCAG
ATATTCTCAGATCTAATAATAACGGTCTTATTTACACGATGTATTCATCTTTATCGCTGCCATCCAAATG
CGTGTGTATGATGCCAAGAAGATTATATATATCTATTAAAATCAAAGGGTGAATTTTTCGCA
CGGATCCAAAAAGAAGAGCTTCCAATGACGCGTCAACGGTGCTTACAATATTGCATTGCGTG
GTGAACTTACTATGAGAGCCATCGCCCAAAGATGTTGATCCGACGTAAAAAATGGCGAATATGGAGC
TAAAGCACAAGGATTGGTTGAATTCATGCAGACACCCGTGCGATTGA |
| SEQ ID NO: 130 | ATGACTAAAACGTTCGACTCCGAGTTTTTAATCTCTATCTCTTGCAAAGACCGTTAGTTTGAATTGA
AACCAGTTGGTGAAACTGCCTCATTTGTCGAAGACTTTAAAGACGAGGATTGAAAAGAGTGGTTAGTG
AAGATGAAGAAGGGCAGTAGACTTAGCAGTACTATCAAAAGGTTAAAGAATCATTGACGATTTT |

TABLE 6-continued

SEQUENCE LISTING

SEQ ID NO: Sequence

ATAGAAGAATCTCTGAACTATTTCCAGAGCAGGTTTCAAAAGATGCTCTAGAGACAAGCGTTTCATTGT
ATCAAAAGTTGAAAGCAGCGAAGGTGGAAGCAAAGGGAAGAAAGCTTTAAAAGAATGGGAAGCATTACA
GAAAAAATTGCGAGAAAAGTCGTCAAATGTTTCAGCGACTCTAATAAAGCTCGCTTTTCTAGAATCGA
TAAAAAGAATTGATTAAGGAAGATTTAATAAATTGGCTGGTAGCACAAAACAGAGAGATGATATTCC
TACTGTTGAAACGTTCAATAATTTACTACTTCACTGGTTTCCATGAGAACAGGAAGAATATTTAC
TCTAAAGATGATCACGCTACTGCTGCTATAAGTTTAGGTTGATTCACGAAAACTGCCTAAATTTTTGACA
ATGTCATCAGTTTTAACAAGTTGAAAGAAGTTTCCCGAGATAAATTAAAATTCGAAAGTTAAAGAGATT
TAGAAGTAGATTACCGACTTGAAGCATGCGTTTGAAATTGAATATTTCGTTAATTCGTCACACAAGCTGG
TATCGACCAATATAATTAACTCGCTTGGAGCAACAACAAACTCGCGATAAAGCTAGACACAGATTCCAAACTGATTC
ATGAACAGATTAATTTATTTAAGCAACAACAAACTCGCGATAAAGCTAGACACAGATTCCAAACTGATTC
CACTTTTCAAACAGATTCTATCTGAAGAATCTCGATCTCAGAGTTTATCCTAAGCAGTTCGAGTCTGA
TCAGGAACTATTCGATTCCCTGCAGAAATTGCATAACAACTGTCAAGATAAGTTTACCGTTTGCAACAG
GCGATCTTGGGATTGGCTGAGGCAGATCTTAAAAAGGTCTTTATTAAAACTAGTGATCTAAACGCATTGT
CTAACACTATTTTTGGAAATTATTCTGTGTTCCAGACGCGCTCAATTTATATAAAGAGTCGCTAAAAAC
TAAAAGAGGCTCAAGAGCTTTGAAGGTTGCCTGCACATAGTAATCATGATTTAATCCAATACTTAGAA
CAATTTAATTCGTCTCTCGATGCTGAAAAGCAACAGTCTACCACCCAAGTACAACCTCTCTTGA
CCGACGAATTATATATGTCGTTTCATTAAGAAGACACCCCAGAAAGTGAAGTGAGGGGGTAAAGGCCAAGAAG
ACTGGAAGCTTTGAGCTCAAAAGAAGAAGACACCCCAGAAAGTGAAGTGAGGGGGTAAAGGCCAAGAAG
GTTTCGAACAAATTAAGAGAATCTATCTAGACACTCTATGAGGCTGTCCACTTTGCTAAGCC
TTTGTATCTTGTCAAGGGTAGAAAGATGATTAGAGGGTCTAGACAAGGATCAAAGCTTCTACGAAGCGTT
TGAAATGGCCTACCAGGAGTTGGAGTCTTTAATCATCCCATTTGACAATAATACACTTCTATCTGGGTGGAT
AGGAAGCCATTTAAAGCGGATAAAATTCAAAATTAATTTGACAATAATACACTTCTATCTGGGTGGAT
GCTAACAAGGAGACGGCTACGCCAAGCATTGTTTAAGAAGCATGGTTTATACTCCTGGGAATCATG
CCAAAAGGCAAAACTTTCTTGTTCGATTATTCGTTAGTTCAGAAGATTCTGAAAAGTTGAAACAACATGA
GACAGAAACCGCAGAGGAAGCGCTCCGACAGGATGGAGAATCCTATTTTGAAAAATACGGTATAAA
CCTCTACCAGGTGCTAGTAAGATGTTGCCAAAGTATTTTTAGCAATAAAAATATTGGGTTTTCAATC
ATTCCAGATGATATTCTACGAATTCGACTCTGTGAATGACTCAAAATGATTGATTTTTTAAATCTTCCATACAGAA
ACATCCCGAGTGGGGATCCTTTGTTTGTTCTCACTTTTTTCGATACGTCGGACTTTGAAGATATGAGTGCTTTCT
ACCGAGAAGTTGAAAATCAAGGTTACGTTATATTATTTCAAATTTAACACAAGAGATTTAGTCCGTATTCAAAGGGAAA
AAGTTGAGCAAGGTAACCTTATACTGAAGAGCTCTGTTGTTGAGAGCGTAATTGAATAACGTAGTGCTAA
GCCAAACCTGCACACTTTATCTATATTTATTTCAGAAATCTTTTTCAGAAGACACAGTTATCAAAGCATCTGATAAAGTGGTACATCC
GCTAAACGGCGAAGCAGAAATCTTTTTCAGAAGACACAGTTATCAAAGCATCTGATAAAGTGGTACATCC
TGCTAATCAAGCTATAGATATAAGAATCCCATACTGAGAAGACGCAGTCCACATTGAATATGACTT
GGTCAAAGACAAAAGATATACCCAAGACAAATTTTTTTTCATGTACCGATATCTTAAACTTTAAGCT
CAGGGCGTTTCAAGTTTAATGATAAGGTAATTGATTCTAAAGGCAATCCCGACGTTAATAATC
GGTATAGAGTCGAGTTGAGAGACATCTTTTATACTTTACCCTGGTGAATCAAAAGGAGAAATATTAGTG
CAAGAGTCCTTGAATACATTAATGTCTGACCAAGGGTCATGTCAACGATTATCAACAGAATTTGACAAG
AAGGAACAGGAAAAAGGCAGCGCTGCCAAGAAGTCTCGGACGACAAGGAAAAATTTAAAGAATTAAAGA
AGGTTATTTATCACATGTGGCTTCATAAAGCTGCATAAAAAAGCTTAATCATCAAATATAACGCAATAGTGCTTG
GAAGANTTCTAATTTTGGCTTCAAAGAGGGTAGGTTCAAGTCGAAAAGAAGGGGAATATGCTCGAG
AAAGCTCTGATCGATAAATTGAATTATCTTGTTTTCAAAGAAGAATTAGGAGAAGTTGGTCATTATC
TTACAGCATACCAACTCATTCATCACCAAGATAGATCCTCCACCAGGTTCTTGAAAGCTTCAAAAGCTTAGGCAAGCAATCTGGATTTTGTT
CTATGTTCCGGCTGATTAATACATCAAATAGATCGTCAAAGAATTCTGCATGAAAAAGTAAATGGATTTTAGGATCAGA
TACCAATCCGTTGAAAAAGTAAACAGTTGCTGTCGATTTAAATGCACACCAAAACGTAAAGATTAGGAACACAATCTAAAT
ATTATTTGAGTTGCAAATTGATTATAAAAATTGACACCAAAACGAAGAAATCAGGAAAGTCAGTGGGAAACTG
GGTTATTTTGTACCATATGGAGATTGTAGATACCAAAACAGGAAGAATCAGGAAACGACCGGTGATCG
AAGAAGTTACGTTACTGAAAAATTAAAGCTCATTTGCGAGCGATTCAAAACGACCGGTGATCG
ATTATGCAAATGATGATAACCTTATTGATGTAATTCTGGAACAAGTAAGGCATCATTTTAAAGAACT

TABLE 6-continued

SEQUENCE LISTING

| SEQ ID NO: | Sequence |
|---|---|
| | ACTATGGTTGTTAAAGCTAACCATGACCCTTAAGGCACTCCAAGATAAAGTCAGAGGATGATTTTATCCTC
TCTCCAGTGAAAAACGAACAAGGTGAGTTTTACGACTCAGAAGAAGGCGGTGAAGTCTGCCTAAGGAT
GCTGATGCCAATGGAGCTTATCACATCGCTCTGAAGGGGCTATGAAACTTACAGCAAATTAACCAATGG
GAAAAAGGTAAAACTTAAACCTCGCCATAAAGAACCAGGATTGGTTCAGCTTTATCCAAGAAAAACCA
TATCAAGAATAA |
| SEQ ID NO: 131 | ATGCACACAGGAGGTCTACTCTCGATGGATGCTAAGGAATTTACCGGTCAATATCCGCTGTCCAAAACTT
TGCGTTTTGAGCTTAGACCTTAGCCTATTGGCCGAACGTGGGATAACCTAGAGGCTTCTGGTTATTTGGCGGAAGA
TAGACATAGAGCTGAGTGTTATCCCCGAGCTAAAGAATTGCTGATGATAACCACAGGGCGTTCCTGAA
TAGAGTTCTACCGCAAATCGATATGGATTGGCATCCAATTGCTGAAGCTTTCTGCAAGTGCACAAAAA
TCCAGGTAATAAAGATATAATTGCTCAGGATATAATTGCAGCTTAGTAAGAGAAGAAAGAAATTTCCGC
TTATTTGCAGGATGCTGATGGATACAAGGGGTTGTTCGCGAAACCTGCCCTGGACGAAGCTATGAAAAT
AGCTAAGGAGAAACGGCAATGAATCTGATATTGAAGTTTTGGAAGCCTTCAATGATTTTCCGTTTATTTC
ACTGGTTATCATGAGAGTAGGGAGAGATATATACTCAGACGAAGATATGGTATCCGCCTATCCATA
ACTGAAGATAATTTTCCAAGGTTCGTCGTCGAACGCGTAATTTTGAGACTAAATAAATGAATCGCACCCGG
ATATTATTTCGGAAGTGTCCGGTAATCTCGGGGTAGACGATATTGTAAATATTTGATGTGTCCAACTA
CAATAATTTCCTTAGTCAAGCAGGAATTGATGACTACAACCATATTATAGGAGGGCATACAACTGAAGA
CGGTCTCATTCAAGCTTTTAACGTAGTGTTAAACCTAAGGCACCCAAAAGACCCAGGTTTTGAGAAAAT
TCAATTTAAGCAACTCTACAAGCAGATACTGAGCGTTAGGACTAGTAAGTTCATATATCCCAAAGCAATT
CGATAACTCAAAGGAAATGGTCGACTGTATATGCGACTACGTCTCAAAAATAGAAAATCTGAAACAGT
AGAAAGAGCTCTGAAATTGTCTAATAAGTTAATTATATCTTCTTTTGATTTAAGAGGTATTTTCGTAAATAAAAA
AACCTTCGATTTTGTCTAATAAGTCATATAAGAAATCAGTGTATGACGCAATAGAGACAGCTTTGATGCACAGTT
CCAGCAGTGAAATCATAAGAAATCAGTGTATGACTCTGCGAGGCAATAACCGCTGAAGACATATCTTCA
GTTCTGTGAAAAGTTCAGCGACGCTCCTTTCATTAACGACTTAAGGGCTGTAGATTTGGATTCTTTTAAATGATGACGG
TTATCTCAGAAACAGCTCCTTTCATTAACGACTTAAGGGCTGTAGATTGGATTCTTTTAAATGATGACGG
CTATGAAGCGGCCTGTGTCTAAAATACGGAGAATCTTGACCCTACATGATCTATTCACGAATTGGAG
ATCTTTAGCGTGGGTGATGAGTTTCCTAAATGTGCCCTTTATAGCGAGTTGGAAGAGGTCTCAGAAC
AACTGATTGAAATCATTCCTTATTTAAACAAGCACAAGAAGTTTTGCACAAGAAGGTATTCAACCG
ACAAAATCAAAGTCAATTTAAGAAAAGACGGTAAATACTACCTGGCAATTTAGACATGAGAAAGATCTCA
GTAGTATTCCTACGAGCGAGTCTTCTTTGAAAAGATGGAATATAAATTGCTCCCTTCTCC
TGTGAAAATGCTTCCAAAAATTTTTGTTAAATGCAAAGCCGCCAAAGAAAAGTACGGGTTGACCGATAG
AATGTTAGAATGCTACGATAAAGGTATGCATAAGTCGGGTAGTGCTTTTGATTTGGGTTTTTGTCATGAA
TTGATCGATTACTATAAGGCTGCATTGCCGAGTACCCAGGCTGGGATGTTTTCGACTTTAAATTCGTG
AGACAAGCGATTACCGATCCATGAAGAAGAATTTATGAACACGTCGGCCGAGTCAGGTTACTATGTCAC
TTAGAAGATTCCATGTTCCAGAGTTTCTGTTTACTGACGAGAAGTCAATTTACTTGTTTCAAATATA
TAATAAGGATTATAGCGAAAACGCACAGTCTTCAAATTGTCCGAGGCGCAGAACTTTTTCAGAAAGTCA
CTCACCACAAATTTGGAATCACCAGTCTTAACATCCGAAAGTTCAGTTCTGTTCCCAGAAACGTCAATG
TCTATTCCTAATGACGCTAAAACGACTCGATCTACAGAGAGTTGACAAGGTATTTTAACCGTGGGATTGCAGGATCA
GTAGAAGAATACCAGACTGCCATCCATGGACACAAAAAAGCGGACCATGACATTGTTAAGGAT
GTGATGAAGCTAAGTTCTTACCTGGACAAGGTCAAGACAAAACAAAAAAGCGGACCATGACATTGTTAAGGAT
AGAAGATTTACTGTAGATAAGAAAGTTATTGATGCATAAATGATGTCCATGAATTTGAAAATCATCGGTATCGATC
CAAATCTTAATAAGAAGTTAATATCTTATTTATGTCACCATGGTCGATAGGAAGGGAAGAATATATTGTATCAAGACAGTC
GTGGTGAGAGAAATCTTATTATGATGTCACCATGGTCGATAGGAAGGGAAGAATATATTGTATCAAGACAGTC
TTAATATTTTAAATGATACGATTACCGCAAAGCTTTAGACGTGAGGGAATATGATAACAAGAAGCTA
GAAGGAATTGGACTAAAGTAGAAGGTATTAGAAAAATGAAAGAAGGTTATTATCTTAGCTGTTAGTA
AATTGGCCGATATGATCATCGAAAATTGAAATAATCGTATAATCGTATCAAAATTGAATCAACGGTTAAGG
CAGGTCGTTCCAAAATTGAAAGACAAGTCTATCAAATTGAATCAATGTTAATCAACAAGTTAGAT
ACATGTGCTAAAAGACAAGTCCATTGACCAGTCGGTGAGCCCTTCATGGTTACCAATTAGCCAATC |

TABLE 6-continued

SEQUENCE LISTING

| SEQ ID NO: | Sequence |
|---|---|
| | ATGTTACGACCTTAGCTGCTGGTAAACAATGTGGAGTAATTTTTACATACCTGCAGCTTTTACTTC GAAGATTGATCCCCACCGGCTTTGCTGCTTATTCGCTCTCTAATGTGAAGAATGTCGCTTCTATG AGAGAGTTCTTCTCCAAAATGAAGTCAGTATATATGCACAAGGCGAAGCAAATTCGCCTTACATT GATTATTTGGATTATAACGTTAAAAGCGAATGGGACGTACCTTATGCACTGTGTATACAGTTGGTGAAC GCTTCACCTACTCTAGAGTAAACCGAGAGTATGTTCGGAAGTCCAAGATATCATCTATGATGCAT ACAAAAAGCTGGTATTAGCCTCGAAGGTGACCTTAGAGTAGAATCGCCGAAAGCGACGGTGAACAT TAAAGTCTATATTCTACGCTTTAAATACGCGTTGGATATGAAGTAGAGTCGAGAGAAGACTATA TACAGTCACCTGTGCAAATGCTCTTCGGTGAGTTCTTTTGTTCAAAAACGCCCGAAAGTCTTTGCCGCA GGAATTCAGATGCAAATGGTGCCTATAATATAGCTCTGAAAGGGATCCCTACAACCTCAGATGTTGAGCGA ACAATACGATCCAAATGCAGAATGCATTAGAATTGCCACTTATAACTAACAAGGCATGGTTAACTTTTATG CAATCCGGTATGAACTTGGAAGATTAA |
| SEQ ID NO: 132 | ATGGATTCTCTTAAGGATTTCACTAATTTATATCCAGTCTGAAAACATTGCGTTCGAATTGAAACCAG TTGGGAAAACTCTAGAACATTGAAAAACCGGTATATTGAAGAGATGAACACGAGCGAATCC TACCGCCGGCTAAAAAAGATAATTGACACATACCATAAGTGTTTATTGACAGCTCCTTAGAGACATG GCTAAAATGGGATAGAAAATGAAATCAAGCTATGCTCTTTGATAAAATTAGAGCTGTTCTTAGGGGTTAATCGTTGGG CACAGGACAGAAGGAAGAGAATAAAGCTCTTGATAAAATTAGAGCTGTTCTTAGAGGTTAATCGTTGGG GCTTTCACTGGTGTATGTGAAGACGGAGAAAACAGTACAAGTGAAAAGAGAGTTGTCAA GAAATTGATAAGGAAATTTTGCCAGATTTCGTGTGTGTCCACCGAGGCTGAGTCTCTTCATTCAGCG TTGAAGAAGCAACAAGGAGCTTAAAAGAGTTTTGACTCATTCACTTCTCTATTTGCTGGTTTTACGAAAACTT TAGAAGAATATATTTATAGATAATATTTTGGTCTTCCAGAAGATTAAGAAGAACCAATCGCTAAAGAACTTGAGCA GCCTAAATTTAGAGATAATATATTTGGTCTTCCAGAAGATTAAGAACCAATCGCTAAAGAACTTGAGCA CATAAGAGCCAGATTTTAGCCGCAGGCGGAATATCCAAAAAGACGAACGCTCCTTAGAGACATATTCTCATT AAATTACTACATTCATGTCCTTTCAAGCTGGTATAGAACATATTAACTTATATAACCAACAGAGAGGGTCGA ACGAAGGTGATGGTGAAATGAAAGGTCTTAAATGAAACAGCTCGTCGGATAGAGAGCAATGTCTTATTG GAGGATAGTTGCCCTTGTTAGGCCTCTATACAAGCAACAGTACAGTACAGATATAACTATATAACTATTTGTCCTTATAAACCAACAGAGAGGGTCGA TACCTGAATCATTTGAAAAGATGAAGAGCTTAGAGACATTAGAAGAATTTTTACGATCACATCGCCG AAGACATCTTGGGTAGAACAGCAATTGATGACTTCAATTTCTGAATCAGACTTTGTCCCGTTATTTATGT CAGAAATGATTCTCAACTTACGACCATCTCGAAGAAATGCTAGGAGATTGGAACGCATTATATGC TAGAGAACGAGCCTACGACCACGACAGAGTCAATTTCATTGGCCGAATCTGAACGCTGTATAGCTTTCTTGACAA CAAGGCCTTAAAGGTGAAGATGTCAGTTGACACATACCTATCAACTTGGGGCAAGAAGGGGTCCTCATGGCTTAAG TGTAAGGGAATTGTCGAGTTGACACATACCTATCAACTTTGGGGCAAGAAAGGGGTCCTCATGGCTTAAG TAACTTGGTGGAAAACGTCTTCGCCTCATATCATGAAGCAGAACAGTATTGTCGTTCCTTCCTTACCCGAA GAGAACAACCTTATTCAGAGACAAGACAATGATAGTGTTTTGATCAAACCTATTGGATATATAAGTGAT TTACAACGTTTCCTTAAACTTGTGGGAATGGGCGATGAACCTGATAACCTTGTACAATAAAGGGCGAAAGGTTTACGGT GAATACAACTATATATAGAAGAGCGTCTGACCAGGTAATACCTTTGTACAATAAAGTAAGGAACTACTTG ACTCGTAAACCATATTCTACTAGAAAAGTTAAATTGAACTTTGGTAATTCACAGCTGCTGAGTGGTTGGG ATCGTAATAAGAAAAAAGATAACTCCTGTGTTATCTGCGAAAGGACAAAACTTTTACTTGGCCAATTA TGAACAACCGTCATAAAAGTTCCTTCGAGATCTAATAAAATGTCCTGAATACAAAGTTGAACAAGGCAAACATATT TTGAAAAAATGGACTATAAATTCTGTCGACAATCTAATAAAATGTGCCTAAGGGTCTTCTTGTCTAAAAA AGTATAGAAATATATAAACCATCCGAAGTTGCTGGAGCAATAGGTCATGGAACGCACAAAAAG GTGACACTTTTAGTATGGATGACTTTGGTTTCACAGAGTTGATTGATTTTTTAAACATTCCATTGAAGCGCACGA GAGTGGAAACAATTTGGTTTACTGTATAAACTGTCATTCCGTAAGGCTATGAAAGCTAGTGTCCTTTTATAGA GATCAGGGAGCTTTATAACTGTCATTCCGTAAGGCTATGAAAGCTATGTCTCTCTGCTACTGTTTATGATC ATCTTCATACACTATACTGGAGAATGCTTTCAATCTATAATAAAGAATTTGCCTGATGTGATCATCATAAATTAGA CGGTAAAGCTGAGATTTTCAGAGAGAATCCCTGAAAAAGCCCATCATCCAACTCATCCGGCAGGTAA ACCGATTAAAAAGAAATCCCGCAAAAAGGGCGAAGAGTTTATTCGAGTATGATGTTAAGTTAAGG ACAGAGACATTACAATGGACAAATTTCAATTCATGTGCCCATTACTACGTTAAGTAACTTAAGTAGTAGCAGG |

TABLE 6-continued

SEQUENCE LISTING

| SEQ ID NO: | Sequence |
|---|---|
| | GTCTAAGGTTAATGATATATGTAAACGCACATATTAGAGAGAGCTAAAGATATGCACGTCATCGGTATTGA<br>TCGCGGAGAAGAAATTTACTTACATTTGCGTTATCGAGGATTCTAGGGGCACCATCTTGGATCAAATCTCT<br>TTGAACACTATAAATGATATATGAATCATGATCTACTAGAGAGTCGGGATAAAGCAAGCAGCAACAAGCA<br>AGAAGAAATTGCCAAACATTGAAGGTATTAAAGAATTAAAGCAAGGCTATCTAAGCCAGGCTGTACA<br>CAGAATTGCCGAATTAATGCAGAAGTGCATATAAAGCTGTCGTAGCTCTAGAAGACTTGAACATGGGTTTCAA<br>AAGAGGGCCAGAAGTCGAAAGTAAAAAAAGCTCTGAAAGATTGCGTTTATTTAAGAGCCTACCAATTCACTG<br>ATTATCTAGTGGATAAAAAAAGCTCTCAAGAAAAAAGCTCTCAAGAAATGGTAAACAAAACGGTTTCTCATTTCTATTCTACATCCCGACTGAATAC<br>CGCCATTTAAAATCGTTCAAAGAAATGGTAAACAAAACGGTTTCTCATTTCTATTCTACATCCCGCATGGAATAC<br>CTCAAATATGATCCAACTACCGGTTTCGTCAACTTATTTCATGCTCAATATGAGAATGGACAAAGCA<br>AAATCATTCTTTCAAAATTGATAGCATTAGCTACAATCCTAAAAAAGATTGGTTTGAATTTGCGTTCG<br>ATTATAAAAATTTCACCAAGAAGGCTGAAGGTTCCAGATCTATGTGCAGATGGCAGATTTTTTGATACACG<br>GAATTAAGAACTTCCGTAATTCACAGAAAAAACGGCCAGTGGGACAGCGAATTCGCCCTAACCGAA<br>GCTTTCAAAAGTCTTTTCGTAAGATACGAGATAGACTAAGTTGTTCAAGTTAACTGTGCAGACAGTATTGTGGATG<br>AGAAGCAAAAAGACTTCTTGCGACCTTCTTAAGTGTTCAAGTTAACTGTGCAGACAGTATTGTGGATG<br>GAAGGAAAAAGACCTAGATACTTACTTGATTTCGTAAGGTTCCAGTGCGTGCAGATGGCAGATTTTTGATACACG<br>TGAAGGCAATAAAATCACTACCAAAAACGCGGAACCTGAGGGTGTAAGCTTAAGCTGCGATTTCTAATAAGGA<br>GTGGGCTCTCAGCAGATTAGCGACAAGTGAGGGTGTAAGCTTAAGCTGCGATTTCTAATAAGGA<br>ATGGTTACAGTTTGTTCAAGAAAGATCCTACGAGAAAAGATTAA |
| SEQ ID NO: 133 | ATGAACAATGTACTAATAATTCAAAACTTCATAGGGATTTCAAAAGACATTGAGAAAT<br>GCTTAATTCCAACAGAAACGACTCAACAATTCATAGTGAAAATGGTATTATAAAGAAGACAGAGTTG<br>CGTGGCAGAATAGACAAATTTGACTGATGATCATGGAATACTACAGAGGGTTCATCTCCGAAACA<br>TTGCTTCTATTGACGACATTGACTGGACCTTATTCGAAAAATGGAATACAGCTGAAGAACGGA<br>GATAACAAGACACTCTTATAAAGGACCAAACGGAATATGAAAAGCTATACACAAAAGTTTGCTAA<br>TGACGATAGATTTAAAACATGTTAGTGCGAAGTTAATTCTGATATTCTACCCGAGTTGTCATTCAT<br>AATAATAACTACTCTGCATCTGAAAAAGAGGAGAAGAACCAGGTTATAAAGTTGTTTTCAAGATTGCC<br>ACATCATTTAAAGACTACTTCAAGATCGCGAATTGCTTCTCTGCGATGATTATAGCTCTTCCAGCT<br>GTCATAGAATTGTTAACGATAATCGCGAAATTTTTTAGTAATCGTGTATATAGACGCATAGTCAA<br>GTCACTAAGCAATGATGATATAAACAAGATTAGTGTGATATGAAAGATAGCCTTAAAGAAATGAGCCT<br>TGAAGAGATATATCTAATTCTTATGAATTGAATTGCCAGAAGACAAGGAATTCTTTTTATAACGAT<br>AACTACAAAAGTTGCATAAACACAGATTTTGTGATATAGCTGATACTCCGAAGTCCGTATAAATTGA<br>ATCTGATGAGGAAGTTAATTCTTCAAAAAGACGTTATCAATCCGTAACGTTTCTTGACAAACATTTCCAGCAACATATCGTTGAG<br>AGACTACGTAAAATTGGAGACAACTATATGCTGAATCTTCAGATAATAAATATACATAGTGTCCAAGTTT<br>TATGAGTCTGTCTCTCAAAAGACATTGGTTGTGCATATAGCTGTATAGCGACCCAAGTTCCGTAATTCATTATA<br>ACACATATTGCCTGGTACGAGAAAAGTAAAGCTGATAAGGTTAAAAGGCCGTCAAAAACGACTTG<br>CAAAAGTCTATTACCCGAGATAAATGAATTAGTGCTCAAACTACAAACTATGCTCAGATGATAATATAAA<br>GCGAAACATAACATCCACGAAATTTCCCACATACTGAATAACTTTGAAGCTCAGGAGCTTAAATATAAC<br>CCGGAAAATACACTTGGTTGAGCAGTTAAAGCCATCGAGTTGAAGAATTAGTGCACAAAGATAACAATTTTTATGCCG<br>AATGCGTTTCATTGGTGTTCAGTTTCATGACGGTAGAGAATTATTCTGAATAACACGATCGTCATCATG<br>AATTAGAGAGGAAATATATGATGACCAAGAAAATATATGCGGTTTATTTATACAATACCTACGCTTGCTGATGGTTGGTC<br>ACAAAAGCCGTATAGTAGTCACCAAGAAAATAATGCAATAATTTAATGAGAGATAACATCTGAAAACAAGGCGCGACTATAA<br>AACCCTAAGAACAACCAGACAGGAAATAATTGAAGGTAATACATCTGAAAACAAGGCGCGACTATAA<br>AAAGATGATATACAATTGCTCCAGGTCTCCAAGTTAATAAAATGATTCCTAAGGTTTTCTCGAGTAGCAAGACT<br>GGCGTTTGAAACTTACCAAGCCTAGTGCGTATTATCCTGAGGGTTATAAACGAAGCATATCAAATCC<br>TCTAAGGACTTTCGATATCACCTTTGCCATGACTTAATCGATTATTTAAAAATGTATCGCAATTCATCC<br>AGAATGGAAAAATTTCGGATTTGATTTTAGTGATACCAGCACTTACGAGGATATCTCTGGGTTCTACAGA<br>GAAGTGGAGTTGCAGGGCTACAAAATCGATTGGACTTACATATATATCGAAAAGGACATAGATTTGCGCAG |

TABLE 6-continued

SEQUENCE LISTING

| SEQ ID NO: | Sequence |
|---|---|
| | GAGAAAGGTCAGCTATATTTGTTTCAAATCTACACAAAGACTTTTCTAAAAAGTCTACCGGTAATGAC<br>AATCTGCACACAATGACTTGAAGAATTATTCTCCGAGGAGAACTTAAAGGACATTGTACTCAAGTTG<br>AATGGAGAAGCCGAGATTTTTTAGAAAGAGCAGTATAAAGAATCCTATAATCAAGAAGGGCTCA<br>ATTCTCGTGAATAGGACGTATGAGGCAGAAGAAGGACCAATTTGGGAATATACAATTGTAAGAAA<br>AAACATCCCAGAAAATATCTACCAGGAATTATAAGTATTTTAATGACAAATCTGATAAGTGAAGGACTGTC<br>TGACGAAGCCGCTAAGCTCAAGAATGTTGTGGGCACCCAGAAGCTGCTACTAAACTGATAATAGTGAAGGACTA<br>CAGATATACCTACGATAAATATTTCCTGCATATGCAATACTAATACTATAAACTCAAGCAAATAAAACAGG<br>TTTTATAAATGATAAATCTGCAGTATATTGCAGCGTAATAGATACTTGTGGTTAATATTGTGAACAAAAGTCTTTA<br>GGTGAACGCAATCTGATCTATGTCAGCGTATATGCAGCGTAATAGATACTTGTGGTTAATATTGTGAACAAAAGTCTTTA<br>ATATTGTGAACGGATATGATTACCAAATCAAGTTGAAACAACAAGAGGGAGCACGCCAAATTGCCCGTA<br>AGGAATGAAAGAGATAGGTAAGAGAAATTAAGGAGGTAAGTTATCTTCATTAGTTATTCACGAAA<br>TTTCGAAGATGGTAATCAAATACAACGCAATAATTGCTATGGAGGACCTGTCATATGGATTAAGAAAG<br>GTAATTCAAGGTTGAGAGACAGGTATACCAGAAATTTGAAACATATGTTGATCAACAAATTAAATTACT<br>TAGTCTTTAAGGACATATCAATAACGGAAAACGGGCGTTTAAAAGGGTATCAACTTACATACATAC<br>CTGATAAGTTGAAAATGTGGGTCACATCTTTTATGTTCCAGCCGCTTACACATCAAA<br>AATCGATCCTACTGGGTTCGTAAACATATTTAAAGTTAAAATTTAAAGATCTGATGCAAAAGAGA<br>GTTATTCAAGAAATTTGATAGCATTAGGTACGATTCAAAATCGTCCTGGTCAGTGTATACTTATGGTGTTAGAA<br>AACAACTTTATAACCAGAATACAGTTGTGATGCTAAAATCGTCCTGGTCAGTGTATACTTATGGTGTTAGAA<br>TTAAGAGACGTTTCGTAACGTCTTCTTCTTACAACGGTCCGATACAATCGACATCACTAAAGATATGGA<br>AAAAACTTTGAAATGACAGATATAAACTGGAGAGATGGTCACGACCCTTAGACAAGATATAATCGATTA<br>TGAAATCGTACAGCATATTTTGAAATTTCGCTTAACAGTTCAGATGCGTAACTCTCTTAGTGAGCTA<br>GAAGATAGAGATTATGATAGACTTATTCTGCCCTGTTCTTAACGAAAATATATCTTCATGACTGGCAA<br>AAGCCGGTGATGCGTCCACTTCCAAAAGATCGTGATGCAAATGCCATTCCATTGAAGGGCTCT<br>ACGAGATTAAACAAATCACCGAAAACTGGAAACAAAATAAGCGATACTTATAG<br>AGTAATAAAGATTGGTTCGATTTTATACAAAATAAGCGATACTTATAG |
| SEQ ID NO: 134 | ATGACCAATAAGTTTACTAACTAATCATTGTTCTAAAACGTTAAGATTCGAGTTAATTCCCCAGGGAA<br>AGACACTAGAATTTATTCAAGAAAAAGGTCTTCTTCCTCCAGGATAAACAAAGAGCAGAATCATACCAGG<br>AGATGAAAAAAACCTAGAATAAATTTCATAAGTACTTCATCGACTTGGCACTATCGAACCGCCAAGCTAA<br>CACATTTGAAACCTACCTGGAGTTGTATAATAATCGGCAGAGCAGAAATAGTGAAGTCGTTTAGTGATGGTGATGCA<br>GATGACCTGAAGAAGGTTCAAGATAATCTGCGAAAGGAAATAGTGAAGTCGTTTAGTGATGGTGATGCA<br>AAGTCAATCTTTGCTATTTAGACAAGAAGAATTAATAACCGTGGAACTTGAAAAGTGTTTTGAAAAT<br>AACGAACAGAAAGATATTTACTTCCGACGAAAATTTAAAACGTTTACTACGTACTTTACAGGGTTCCATC<br>AGACCGCAAAAATGTACTCCGTTGAACCAAACTCTACTGCAATCGCCTACAGATTAATAACGTTACAGGTAA<br>ATTTCGCTAAGTTTTAGAAATGCAAAGGCTTTTGAAAAGATAAAGCAAGTCGAATCGTTACAGGTAA<br>ACTTTCGCGAATTAATTATTAACGATGTCTTGAGTCAGAACGGCATTACTACGTCAATTATCAGTGGT<br>TCAATTAATTATTAACGATGTCTTGAGTCAGAACGGCATTACTACGTCAATTATCAGTGGT<br>TTCACTAAGAATGATTATAAACGCCCAAAATGTTGAATGAATACATTAATAATTATAATCAAACTAAGAT<br>AAGAAGGAAGGCTTCAGAAGGTTCAAGTCAATTGTACAAGCAGATTCGATTTCTAAGATTAGTTTGTCT<br>TTCTTGCCAGCCACCATTACTGATGCAAGCAAGTCTTAAAGGCTATAATTCGATTTCTACAAGATTAACC<br>TACTTTCGTACACAATTGAAGTCAAGAAGAATCAAAAATCTGCTTTGATTAGGCAAACTATATCACAG<br>AAATTTGTCTCCTTTGACACTCAAAAAATTACCGGCCCTAAAACTATTGGTATGAGACAAAGTTAATCAA<br>CAGGTCTTTGGGATTTTTCTGTCTTCTCCACGGCCCTAAAACTATTGGTATGAGACAAAGTTAATCAA<br>AATTTGAAACAGAATATAGTAAGGAAAAAAGGAGAGAATTTTGGATAAAGCGAAGGCAGTA<br>TTCAAAACAAGACTATTTCTATCGCATTCTCCAAGAAGTCTTATCCGAATATATTTGACACTCGA<br>TCACACCTCTGATATAGTTAAGAAACATTCGTCCAACTGCATCCGCAGATTACTTCAAGAATCACTTCGTG<br>GCTAAGAAGAAACGAAACGGATTAAAACTTTTGACTTCATTGCTAACAATAACCGCTAAATACCAATGT<br>ATTCAGGGCATATAGAAATAGCAGACCAGTACGAAGACGAGTTATTACATTTATAAAGCGACCAAAAGTTAATAGA<br>TAATTCTAAAGTTTTTCTTAGATGCTATACTTGAGTTATTACATTTATAAAGCCATTGCATCTAAAATCGG |

TABLE 6-continued

SEQUENCE LISTING

| SEQ ID NO: | Sequence |
|---|---|
|  | AAAGTATTACTGAAAAAGACACTGCGTTCTATGATGTGTTCGAAAATTATTATGAGGCTTTATCTTTATT<br>GAACCCCCTTTACACACATGTCCCGCAATTATGTTACTTACTGTTGAAGCCTTACTCTGAAAAGATCAAATTA<br>AACTTTGAAAATGCTCAGTTGCTGATGATTCTTAGCAATCATGGATAAAAACATAACAAGGTGACTACCTGACGACTATT<br>CTAAAAAAGACGTTAATTATTCTTAGCAATCATGGATAAAAACATAACAAGGCATTTCAAAAATTT<br>CCAGAAGGAAAAGAAAATATGAAAAGACATAGCTTATAAATTGTTGCCTGGAGTTAATAAATGTTGCCA<br>AAAGTTTTTTTAGCAATAAAAAGGTGATACATTTAATTTGAACATTGCCATACTCTGATGATTTTTTAAGGA<br>AGGAAACACATAAAACATGAAGAAGTTGAACACCAAGGTTATAGATTAACTTCAAGAATATAGATTCTGAA<br>CTCTCTAATAAAACATGAAGAAGTTGAACACCAAGGTTATAGATTAACTTCAAGAATATAGATTCTGAA<br>CTAAGTGGATTTTACAGAGAAGTTGAACACCAAGGTTATAGATTAACTTCAAGAATATAGATTCTGAA<br>TACATTGATGGTCTTGTAAACGAGGTAAACATATTCCTGTTCCAAATCTACTCTAAGGACTTCTCACCTTT<br>TTCCAAAGGAAAACCTAATATGCATACGTTGTACTGGAGGCTCTATTTGAAGAACAAAATTTGCAAAA<br>TGTAATCTACAAACTGAACGCCAAGCTGAAATATTCTTCAGAAAAGCCTCAATTAAGCCAAAAAACAT<br>TATTCTTCATAAAAGAAGATCAAGAATTGCGAAGAAACATTTATTGATAAGAAGACAAGACTTCCGA<br>AACCCAGAGATGATTTACGTTATATAGAACATTTCTCTATATTCAACGAGAAGAACAAAACAATAGAACAT<br>AATCAAGATAAAAGGTTTACTGTTGACAAATTCAATTTCATGTGCCTATCACAATGAACTTTAAGGCC<br>ACAGGTGGTTCGTACATTAATCAAACTGTTGAGACATCTGGTGTATCTAACACTCATTGATCAACACATCTTGAAG<br>GGTCTTGATAGGGTGAGAGACATCTGGTGTATCTAACACTCATTGATCAACACATCTTGAAG<br>CAAGAATCATTGAACACACTTATCACAGACTCTCGACTCCGATATCACAAACTCCTTGACAATAAA<br>GAAAACGAAAGGGATCTTGCCAGAAAAATTGGGGTACAGTTGAAAATATTGAAGAACTAAAAGAAGG<br>TTACATTTCCAAGTAGTTCACAAGATTGCAACACTCATGTTGGAAGAAAACGCAATCGTTGTCATGGA<br>AGATTTAAATTTCGGATTTAAGAGAAGATTTAAAGTAGAAAACAAATCTACCAGAAGTTGGAGA<br>AGATGTTAATTGACAAATTGAACTTCTAGTCTGAAGAACAACAGCCTCAAGAATTGGGCGTCTAT<br>ACAACGCTTTACAACTGACAAATAATTTGAGTCATTCCAAAAGATGTGGTAAGCAGAGTGGTTTTTTGTT<br>TTATGTTCCGGCATGGAACACCAAAATCTCTTGAGAAGTTCGAGGCGATCCGTTTAACGCTGAAAAG<br>TATGAAAATGGATAAAGCAAAAGCTTCTCTTGAGAAGTTCGAGGCGATCCGTTTAACGCTGAAAAG<br>AAGTACTTCGAGTTGCATCTACGGTGAGCGAATCGAAACTAAAAGGCAAAAGCAAAATAATAAGTTGTA<br>TGGACTATTTGCACGTACGGTGAGCGAATCGAAACTAAAAGGCAAAAGCAAAATAATAAGTTGTA<br>AGCACACCCATTAACTTGACAGAAAAGATAGAGAATTTTCTTGGAAAAAAACCAAATTGTATATGTGAC<br>GGTAACTGTATCAAGTCACAAATTGCTTCTAAAGACGATAAGGCCTTCTTCGAAACTCTGCTATACTGGT<br>TTAAAATGACGTTGCAAATGAGAAACAGTGAAACATAGAACTGATATCGAACTATTTAATATCACCCGTGA<br>TGAACGATAATGGTACCTTTTACAATTCAAGAGATTACGAGAAATTGGAGAACCCACTACTACCAAAAG<br>ACGCAGACGCTAATGGTGCCTACCATATGTCAATTTGTCAATTTCAGAATAGAGATTGGTTGCAATTCGTCCAGAAAATA<br>CCGACTTAACTAAAAAGTTGATTTGTCAATTTCAGAATAGAGATTGGTTGCAATTCGTCCAGAAAATA<br>AGTAA |
| SEQ ID NO: 135 | ATGGAACAGGAATACTACTTGGGTTTGGATATGGGAACTCGTTCAGTCGGTTCGGTTGGCGTGTTACGGACTCC<br>GAGTACCACGTGTTGAGAAAACACGGAAAGGCTTTATGGGGTCAGACTATTCGAATCAGCATCGACC<br>GCGGAAGAGAAGAAGAATGTTTAGAACTTCAAGAAGAAGGCTGGATCGTAGGAAGTCGGATAGAAAT<br>TTTACAAGAAATATTCGCCAAGAAATCTCAAAAAAAGATCTCAGGATTTTTTCTACGTATGAAGGAATC<br>CAAATACTATCCGGAAGATAAACGTGATATTAATGGCAATTGTCCAGAGTTACCCTATGCTTTATTGTG<br>GACGACGATTTCACCGATAAAGATTACCATAAGAAGTCTCCAACAATTTACCATCGAAAAGATGTTA<br>ATGAACACTGAAGAACCCCGGATATAAAGACTGGTCTATCTAGCCATTCATCATATGATGAAACACAGG<br>GGACACTTCTGCTTCAGGGATATAGATTGTTGAACAGATCAAACGAAAAAGTTTGTACAACATTTCTAAATTATTGG<br>AAAATATTAAAACGAAGAATAACATGTTGAACAGATCAACGAAAAAGAAAAGCTGATCAAGCTTTAAAAGC<br>TCGATTTCTGAAAGATAACATGTTGAACAGATCAACGAAAAAAGAAAAGCTGATCAAGCTTTAAAAGC<br>GAATTGGAAGAATTGAATGAAACAGCAGTATTGATTGTTAGCTGGGGGACTCCTTCGCCGATAATGGCTACGATTAT<br>ATAGGCGAAGTGAAAATGAGCTGGGCGAACAATTCTACATTATGAGACTGTTTATGAT |

TABLE 6-continued

SEQUENCE LISTING

| SEQ ID NO: | Sequence |
|---|---|
| | TGGGGGGTGTTAGTCGAAATCCTTGGCAAATACACTTCCATCTCCGAAGCTAAGGTGGCAACCTACGAA |
| | AAGCATAAAAGTGATTTGCAATTCCTAAGAAATTGTCCGAAGTACTTGACCAAAGAAGAGTACAAG |
| | GATATTTCCTATCAACATCGGACAACTGGAGAATTATTCAGCTTATATGGCATGACGAAAATTAATG |
| | GTAAGAAAGTTGATTTGCAATCCAAGAGATGTTCTAAAGATGAGTATTTACGATTTCATTAAAAATG |
| | TCCTAAAAAGTTGGAGGGCAACCTAATCGTGATATGCGTTATTCCATACCAAATACACTTGAAGAAG |
| | CTACCAAAGCAAGTTAATCTGAAGGACAAAATTGATTAATTCAAGAAAATGAAGACTGGTACAAATTATTT |
| | ATCTTGGTAACTTGAGGGACAAAATTGATTAATTCAAGAAAATAGACGATGGTAAGGAAGGAAGTTCACA |
| | GAATTTAGAATACCTTACTACGTGGGCCCTTTAAACAAAATAACCATGGAATTTCGAAAACGTGTAGATATTGAAGCT |
| | TGGGCAGTCGAAAGTCCAATGAAAAAATTTACCCATGGAATTTCGAAAACGTGTAGATATTGAAGCT |
| | TCTGCTGAGAAATTTATTAGGAGAATGACAATAAATGCACTTATCTTATGGGGAAGACGTGTTGCCT |
| | AAAGATAGTTTATTATATTCAAAGTATATGTCTTAAAATGAATTGAATTAAACATGTTAAATTAGATGTGAAA |
| | AACTTTCCGTCGAATTGAAACAAAGATTGTATACAGATTGTATTCTGCAAATAATAGAAAAGTAACTGTAA |
| | AGAAGATTAAAAACTACCTTAAATGTGAAGGCATTATCACGACTTTAAGGAAATGTTGAGATCACTGGTATCGATG |
| | GTGATTTTAAGGCATCTTTACCGTCATAATCGTGCTCTTCGGAGCACAAACAAAATTATTGAAAAGA |
| | AAAGACAAAGAGAACATTATCACCCTGCATTACGAATTTCGTACCCCAATTGAAGAAAATCTGCGCTCTGTCTTATACTGG |
| | GATTGAACCGCCCTATACCCTCAGATTCTAGAAGAAGTTTCTAGAAGAAATTACTGCTCCGGATCCTGAAACTGGGGAAGTCTG |
| | ATGGGGTCGTTTTAGCAAGAAGTTTCTGGGAATGGAATAATTAATTTAATGCAAGCTGTACTTGTATTATACGCAAAA |
| | GAATATAATTACCGCCTATGGGAATCGAATAATCGATTCATTAAATGAATGATTTGAAAGATTTGAAAGATTCATTGAAAGATTCAAGAATACAGAATT |
| | ATGGAAGAAGTCGAAACTTACAATATGGGAAACAAACAAAACTTTGAGCTACGACAAGCAGTAGAGAA |
| | TATGTATGTCTCACCATCTGTAAAGCGCAGATCTGGCAAACCTTGAAGATAGTTAAAGAATTAGAAGA |
| | AGTGATGAAGGAAGTCCAAAAAGGGTTTTTATGGAAATGGCCCCGAGAAGAAACAAGAATCTAAAAGGA |
| | CGGAAAGTAGGAAGCACTTATAGATCTATATAAAGCCTGCAAAAATGGTGAAAAAGATTGGTA |
| | AAGGAATTAGGTGACCAAGAAGACCAAAATTGAGATCTGACAAGCTGTACTTGTATTATACGCAAAA |
| | GGGCCGGTATGTATTCGGGTGAGGTAATAGAAATTGAAAGATTTATGGGATAACACTAAGTATGCAT |
| | TGACCATATTTACCCCCAGTCTAAGACAATGGACGATTCATTAATAACCGAGTTCTTGTCAAAAGAA |
| | TGAATGCCACAAAGAGCGATAAGTACTACCATTGAACGAAATAAGACATGAACGAAAAGGTTCT |
| | GGAAATCATTGTTGACGTGGAGTTAGCTGCTTTATCGAAAGAACAAATTGTTGAACACAGTCTACAAAGCAG |
| | TATCTCCAGAGAGTTAGCTGCTTTATCGAAAGAACAAATTGTTGAACACAGTCTACAAAGCAG |
| | TTGCAGAAATCTTAAAACAAGTATTTCCAGAATCCGAAATTGTCTACGTCAAAGCCGAACAGTAAGTA |
| | GATTTAGAAAAGACTTTGAATTATTGAAAGTGAGAGGTTAACGACCTACATGCTAAGGATGCTT |
| | ATTTAAAATAGTCCTTGTAATTCGTATTACGTGAAATTCACAAAAACCATCTTGGTTCATCAAGGA |
| | GAATCCTGGTAACGACATACACTTGAAAAGATGTTTACATCAGGATGAATATCGAAAGAAAAATGGTGA |
| | GGTTGCGTGGGAGGTAGGCAAGAAGGGAACCATTGTTACTGTAAAGCAAATTATGAATAAAACAATA |
| | TACTTGTTACGAGACAGGTGCACGAAGCCAAAGAAGCGTGTGTTAGCTAGTATAGAAAAATATGGGGGCTACAA |
| | AAAGGTCAGATAGCAATAAAAGAACAATGATGAGCGTTTAGCTAGTATAGAAAAATATGGGGGCTACAA |
| | TAAGGCAGCTGGTGCTTACTTCATGTTGCGAATCAAGAATAAGAGAGATCCGATCCGACCAT |
| | AGAGTTTATCCCTGTACTTGAAGAATAAGAGTTCGTAAAGAAATTGACGAAAGCATCGCATTGAATTCTTGGAA |
| | AAGGGCGCGGTCTAAAGGAGCCAAAAATATTGTTAAAGAAATTAAAATAGACACCTATTCGACGTC |
| | GATGGGTTTAAGATGTGGCTTAGTGGCTACTGGGGACAGATTATTATTCAAGTGTGCCAATCAGTAA |
| | TCCTTGACGAGAAAATCATTGTTACAATGAAAAAATGTTAATTTAAGGGCACAAGAAAATAA |
| | GAGAACTAAAGTTGGAGAATACGGTTACAGAATTAGGCATACAAATCTTCAATGAGATTTTATAACACTTTG |
| | TCGACAAATTGGAGAATACGGTTACAGAATTAGGCATACAAATCTTCAACTCTTTTGAGATCCTACATATCTTCA |
| | AGAAGGAGTTGAGCGACTTTCTTCTTGAAGACAAATCTTTGAGATCCTGTATATTAGTCATGAAC |
| | GTGTCAATCTTCTGCAGCTAATTTGAAATGAATTGGAAGTCCTGGTAAGGCTGGTATATTAGTCATGAAC |
| | AACAACATATCTAAGTGTAATAAGATTAGTATAATTAACAATCACCGACAGGTATCTTTGAAAATGAA |
| | ATTGATTTACTTAAA |
| SEQ ID NO: 136 | ATGAAATCATTGACTGACTTCACCAACTTGTACTCCCTGTCTAAAACATTGAAATTGAAATGCGACCTG |
| | TTGGTAACACCCAAAAGATGTTAGATAATGCAGGAGTTTTCGAAAAGATAAACTGATCGAAAAAAT |

TABLE 6-continued

SEQUENCE LISTING

| SEQ ID NO: | Sequence |
|---|---|
| | ACGGTAAAACGAAACCATATTTCGATAGGTTGCATCGGAATTTATAGAAGAAGCTTTGACTGGTGTAG |
| | AATTAATTGGCTTAGATGATGAGAATTTCCGTACTCTAGTCGATTGGCAAAAAGATAAAAAGAACAATGTTG |
| | CCATGAAGGCATACGAAAATAGTCACAAGACTAAGAACAGAGATCGGGAGAAAAATTTCAATTTGAAG |
| | GCAGAAGACTGGGTGAAGAACAAATATCCAATATTGGGTCTTAAGAATAAGAATACTGATATATTGTTC |
| | GAGGAGGCCGTTTCGGTATTCTTAAGGCAAGATATGGTGAAGAGAGAAAGACACGTTTATTGAAGTGAG |
| | GAGATTGATAAAACCGGTAAGTCCAAAATCAACCAGATCTATCTTCGACAGTTGGAAGGGCTTCACT |
| | GGTTATTTAAGAAGTTCTTCGAAAACCTTAAGCGTTTTATTGATAATCCTTATAAAACATGATGTACTTCCACGGCTATTG |
| | CTACAAGAATTATCCGACCAAAACCTTAAGCGTGTTTTTATTGATAATCCTATTCCCAGTTTTTTCTATAGATTTTT |
| | GAAAGTAGATTTGGCTGCGAAACTGGCATTGCTGATAATTCTTAGTATCTCTATAATAAATAATTGGTGGAGACATTGAAAA |
| | ATAATAAATGTTTGCTGCAAGATGCATTGCATACTACTATAATAATAATCAATAATAAGGACCAGAAA |
| | ACGGAGAGAAGCTTGGCCTTAATGAGTGATAAATCAATAATAATAGAACCAAATAATAAGGACCAGAAA |
| | ATCCCTTTCTTTAAATTGCTAGACAAACAGATTTGTCTCCCAGTTTGCTAAAACAGCTGAAGAAAGACAAAGATTGTGA |
| | ACGATACTGAATTGATTGAAGCTTTTCGTAGAAGAAACAATTCTAAATATGATCTAGCCCAGATTTATATAAGTCAAGA |
| | AGCTTTCAATACAATAAGTAATAAGTGGACAAGTGAAACAGAAACTTTTGCTAAGTATATTATTCGAAGC |
| | CATGAAGTCTGGTAAACTTGCCAAATACGAAAAAAGATAACAGTTATAAAATTTCCAGACTTTATAGC |
| | CCTTTCACAGATGAAGTCTGCCCTTATTGTCGATATCCTTAGAAGGTCATTTTGGCTATATTTCTATATGAGTTCAATT |
| | AAGATAAGCAAGTTCCAAGAAAGACTAATTGGGAACAATTTTGGCTATATTTCTATATGAGTTCAATT |
| | CATTATTTTCCGATAAAATCAACACTAAGGATGGAGGACTAAGCAAGTTGGCTACTATTTGTTCGCAA |
| | AAGATCTGCACAATTTGATTCTATCAGAACAAATAGATATACCAAAAGATTCAAAGTTAACTATAAAGG |
| | ATTTCGCAGATTCCGTCCTCCACCATTTATCAAATGGCTAAAATATTTGCCGTTGAAAAAAGAGAGCGTG |
| | GTTAGCAGAATACCAAGTTGGACTCGTTTTATACTCAGCCAGATACTGGATACTTGCAATTCTACGATAAT |
| | GCATACGAAGACAATTGTACGGTATACAATAAACTTAAGAAATTACTTAACCAAGAAGCCCTACAGTGAA |
| | GAAAATGGAAGCTGAACTTGAAAATTCGACTTGGCAAATGGTTGGGATAAAAATAAAGAAAGTGA |
| | CAACTCCCGACTGATTTTGCAAAAGGGTGGGAAATATTACTTGGGTTTAATCACAAAAGGCCACAATAA |
| | GATTTTTGATGATAGATTTCAAGAAAACAATTCATAGTTGGTATAGAAGGTGGCAAATACGAAGAAATTGT |
| | CTATAAATTCTTCCCTGATCAAGCCCAAAATGTTCCAAAAGTTTGCTTTTCTGCTAAAGGATTGGAGTTT |
| | TCCGGCTAGCCAGGAGATCCTTCGTATCTACAACAATGCTGAATTCAAAAAGGAGAACCTATAGCA |
| | TAGATTCTATGCAAAAACTGATAGATTTTTATAAGGAGATTGTTTAACAAAGTACCGAAGGCTGGGCCTGCTA |
| | TACATTTAGACATTTAAAGCCACCAGAAGAATACCAAGGTATCCAGATACAATAAATAACATTGGTGAATTCTTTCGGGACGTTGC |
| | CGAAGACGGCTATAGGATCGATTTTCGAAATTCATAATAAGGACGTGGAATTTGGATAAGGCGAGAGATGTAAATCGAA |
| | TGAGCTGCACCTTTTCGAAATTCATAATAAGGACGTGGAATTTGGATAAGGCGAGAGATGTAAATCGAA |
| | GACCACTCCAAAAGAACTTGCATACTTTATATTTTGAGTCCCTTGTTTTTCTTAATGATAACGTCGTCCAAAATT |
| | TTCCAATAAAGTTGAATGGACAAGCGGAACGGAAATTTTCTATCGGCCTAAGCACAGAAGACAAATAGAAT |
| | CAAAGAAAAAGATAAAAAGGAACAAGAATAAAGTCATTGATCACAAACGATACTCTGAGAATAAATATTTTCC |
| | AGTACCATTGACACACTCAACAGGACTAAGATGACTCTTATAGATTTAATGCTCAGATTAATAATTTTTT |
| | GGCAAATAACAAGGATATTAACATATTGGGGTGGATAGAGCGGGTCTCTAAATGAATTGAAAAGCACTTCGTATATTACTCGT |
| | CATCACTCAGGCTTCTGATATATTGGAAAGCGGGTCTCTAAATGAATTGAAAAGCACTTCGTATATTACTCGT |
| | AAGCTAGGTAAAAAAGTCGAAACAGACAGCCTGCGCGCAAGATGTTCAAGGATTA |
| | AAGACCTTAAAAGTCTACATAGTCAAGTAGTTGAAGAGTTAGAAAGTTAGCCGATCTTGCTATTAAACATAACG |
| | CAATCATTATTCTGGAGACTACTAAGTGTTTTGATAGAATGCGTTTTGTGACAATCGGTTAAGTATTTAA |
| | ATCAGCAGCTTGAGAAGGCTTTTGATAGAATGCGTTTTGTTTGTCCTAGTTGACAAAGGTGGCATAGAAATCCTG |
| | AACAAGCTGGTCATCGTTCATCGTGTAAATCAGCTGGCCACCCTTTGAAACATTGAAAATGGAA |
| | AACAACAGGATATTATTTCTATACTCAAGCGAGTTATCACGAGTTATCGTAAATCGACCCAGTGACAGGATGAA |
| | GACCACACCTTTATCTAAAATATTTTTCTGCTAAAAGGCAAAGATGACATCGTAAGTTACAAAAT |
| | AGAATTTGTCAACGATAGATTTGAATTGACTTACGATATTAAAGATTTTCAGCAGCAAAGAATACCC |
| | AATAAAGACAGTGTAAAATCTCAAGGTTAGATGGATAGATTAGTGATGGGATAAAATCAATCAA |
| | ACAAGGGTTACAACATTACTAACTAATATAACTATAATATTCAAGAATTGTTACTAAGTACGAA |
| | TTGACATAACCAAAGACTTACTAACTAATATAACTATAATATTCAACTATTGACGAAAACAAAATACCTCATTTTCCG |

TABLE 6-continued

SEQUENCE LISTING

| SEQ ID NO: | Sequence |
|---|---|
| | CGACTTTATTTTTATTTCAACTTGATCTGTCAAATTCGTAACACGGATGATTCCGAAATTGCCAAGAAG |
| | AACGGAAAAGATGATTTCATCCTACTCCAGTGGAACCATTTTTGACTTCAAGAAAGATAATGGTAAT |
| | AAGTTGCCTGAGAACGAGATGATAACGGCGTTATAATATCGCTCGGAAGGTATTGTAATTCTTAAT |
| | AAAATATCTCAGTACTCTGAAAAGAACGAAAACTGCGAGAAATGAAGTGGGGCGACTTGTATGTATCT |
| | AATATAGAATTGGGATAATTTCGTTACTCAAGCCAACGCAAGAGACATTGA |
| SEQ ID NO: 137 | ATGGAAAATTTAAAAACCTATATCCAATTAATAAGAACACTTAGATTTCGAGCTTAGGCCATACGCAAA |
| | ACACTAGAAAATTTTAAGAAGTTCAGGCCTATTAGAAAAGACGCCTTAAGGCAATTCCAGAAGATCA |
| | ATGCAGGCAATTATTGATGAGAATTTAAAGACTATCGAGGAAAGGTTGAAATACACTGAATTCTCT |
| | GAGTCGCGATCTGGGAAACATGACTTCCAAGGATAAAAGATTACCGATAAGGCTGCTACCAACCTCAAA |
| | AAGCAAGTCATCTTATCGTTGATGATGAAAATTTTAATAACTACTAAGGCTGTTTAACCACGATGACG |
| | CCCTATTCAAAAATGATCCGTCCAACCCCGTAATTTCAACTTTTAAGGGTTTTACCACGTACTTTGTAAAT |
| | TTTTTTGAGATTCGTAAACATATCTCAAAGGAGAATCGTCGGGTTCATGGCCTATAGGATAATTAAAGTCTCAAT |
| | TGGAAGGTATTGACCAAATAAATAATAACTATAGTAGAGTCATAACTCAAGCGGTATCACAC |
| | ATTACAATGAAATATCGGTGGTATATCTAAAAGTGAGAACGTAAAAATACAGGGAATAAACGAGGGG |
| | ATCAATCTATACTGTCAGAAGAATAAAGTAAAATTACCAAGACTAACGCCATTATACAAATGATTCTG |
| | TCTGATAGAGTTTCCAACTCGTTCGTGCTTGATACTATAGAAAATGAACTAATTAATTGAGATGATTA |
| | GCGACTTGATTAATAAACAGAAAATATCTCAAGACGTAATAATGTCAGACATTCATAGACATTTTCATAA |
| | AATATAAACAGCTTGGTAATTTACCGGGATAAGTTACTCTAGCATCGTGAATGCTATTGCTCCGATTA |
| | TGACAATAATTTTGGTGACGGAAAAGAAAATCATTGAGAACGATAGGAAGAAAACCCTTGAA |
| | CAAACGTATACTCAATTAACTACAGAAACTGTTAACAGACACCGATGTATCATCTAATATAAAAT |
| | GAGATATAAGGAACTGAACAAAATTACAAGAATTTCAAGACGTCAACAATTTCATAG |
| | CATTAAGAATATTAAACAGAGTGAAAAGACAAACTTGATTAAAGATCTACTAGATATACTGAAATCAAT |
| | ACAGAGAATTCTACGACTCGTTTGATATAGTTGATGAAGACAAAAATCCTAGTGCTGAGTTTACACGTGG |
| | CTAAGTAAAATGCGGAAAATGTAGATTCGAGTTCAACTCTGTTTATAATAATCTAGGAATTATTAA |
| | CTAGAAAGCAGTATTCTGATAAAAGATAAAATTGAACTTCGACTCCTACGTTGGCAAAGGGTTGGG |
| | ATGCAAACAAAGAAATCGATAACTCCACCATAATAATGCCTAAGTTAACAATCAGATAGGGGGATTACG |
| | ATTATTTTTTGAAAAATGCAGTATAAATTACTCCCCAGCACAAATCTACCCCTTGAAGACAATGG |
| | TCTTTTTGAAAAATGCAGTATAAATTATATCCAGACCCCATCCAAGATGCTTCAAAGCAATTCTGTCA |
| | AAAATTTGAAGGCTAAACACCCCTACTACTCCTGAATTTGATAAGGAAGTATAAGGAGGCCGACCAAA |
| | AAGGGTCCCAGATTTTGAAAAAGAAATCTGCAGATAGATGATAATGTTTAAGCATGGTTTGGTAAATC |
| | ATGATGAAAATATCAGGATGTCTTTTGGATTCAATTTGAGAAATACAGAGGATTACAACTCATATACAG |
| | AATTTCTGAGGACGTCGAACGTTGCAACGTTGCAATTATATCTCAGTTTCAACAGATCGCAGACACTTCAAACTT |
| | AATTACGACGGAAAATTGCAGTTTTCAAATCTGGTCAACAGACTTTAGTATTGATTCAAAGGGTACA |
| | AAAACCTAAATACATATATTCGAAAGTCTATTCTCGAAGAGAAACATCATCGAAAAAATGTTCAAA |
| | CTGTCAGGCGAAGCTGAAATATTCTACCGTCCCCAAGCCTTAATTATTGTGAGATATCATTAAAAA |
| | GGACATCACCATGCGAGAGTTAAAGATAAATTCGATTACCCAATAATTAAAGATAAAGATATCTCCAG |
| | GATAAGTTCTTTTTCCATGTACCTATGGTTATTAACTACACAAGTCGGAAAAACTAAACTCGAAGTCATTAA |
| | ATAATAGAACTAACGAACAATTCAACACATATAATTGGTATTGATCGTGGCGAAAGACATT |
| | TAATATATCGACTGTGTTGTGATGTTTCAACAGGAGAATTGTTGAACAGAAACATCTGATGAAATTAT |
| | AAACAGATAACATCAAAAGGCTTGAGCATAAATGAATCATTATCTAAATAATGGAGGAAAAGTCGAAGA |
| | CTCGCAGTAACGAGAGAAGTTGGAAGCAATGAAACCATAAAACCATAAAAGAGCTTAAAGAAGGTTACATT |
| | AGTCACGTCATCAATGAAATGAAATTACAAGAAAGTATAACGCTTGATTGTGTAATGGAAAATCTA |
| | AATTATGGTTTAAGCAGTTAACTACATTATTCAAGAATCAAAGTCTATCAGAAATTGAAACGGCACTT |
| | ATTAAAAAGTTTAACTACATTATTGATAAAAGGACCCAGAAACTTATATTCATGGTTACCAACTGACG |
| | AACCCAATCACAATCGGAACAATTGGAACCAAAGTGGAATTGTTTTATACATTCCAGCTTGGAAT |
| | ACATCCAAAATAGACAGACCCTGTCACGGGTTTGTCAACTTGTTATATGCCGACGATTTAAAGTATAAAACC |
| | AAGAACAAGCAAAGTCTTTATTCAAAGATTGATAATATTATTTCGAAAACCGTGAATTAATTCGA |

TABLE 6-continued

SEQUENCE LISTING

| SEQ ID NO: | Sequence |
|---|---|
| | CATAGATTTTCTAAATGGAACAACCGTTATTCAATAAGTAAAACTAAATGGAACACTCACCTCATACGGC ACTCGTATCCAAACCTTTCGGAATCCCAAAAAAATAACAAATGGGATTCTGCGAATACGACTTGACC GAGGAATTTAAATTAATTCTTAATATAGACGGTACACTCAAAAGTCAAGACGTGAGACATAACAAGAAG TTTATGTCGTTATTCAAGCTTATGCTTCAGTTGAGGAACTCCGTTACAGGCCACTGATATTTGATTACATGAT TTCACCAGTAACGGATAAGACTGGGACTCATTTCGATTCTAGGGAAAATATTAAAAATTTACCTGCTGAC GCAGACGCAAACGGCCATACAATATGACAAGAAACGGGATTATGCCATTGAGAATATTTATGAATGG CATATCAAGATCCATTAAAGATCAAGACTACTTAAAATACATTCAGAATCAGCAAGAATAA |
| SEQ ID NO: 138 | ATGACCCAGTTTGAAGGTTTCACCAATTTGTACCAAGTAAGTAAAACCTTGAGGTTCGAATTGATCCCAC AGGGCAAGACATTGAAGCATTGAAGCATATTCAAGAGCAAGGATTTATAGAAGAAGATAAAGCGAGAAACGATCAC TATAAAGAGTTAAAACCCATTATTGACAGAATCTATAAAACATACGCCGATCAATGCTTCAATTAGTG CAATTAGATTGGGAAAACTTGAGCGCTGCCATCGATTCCTACAGGAAGGAAAAACAGAAGAAACAAG AAATGCTTAATCGAGGAACAAGCAACCTATAGAAACGTATACAGGATTACTTCATCGGTAGAACTGA TAATCTAACAGATGCAATAAATAAGAGACATGCTGAGATATAATAAGGACTATTTAAAGCAGAATTATT CAACGGAAAGGTGTTGAACAGTTAGGTACCGTTACAACTACTGACGATGTGAAAATGCCTTGCTGAGAAG CTTTGACAAGTTTACTACCTACTTTTCGGGTTTCACGATAATCTCCGAAAATCGCAAAAATGTATTTTCGCGAAGAT ATTTCAACTGCAATCCCTCATAGGATTGTTCAAGATAATTTAAAGACAATTTGAGAATGTAAAGAACTGTCACATTT TTACAAGGTTAATTACTGCGGTTCAAGTCTAAAGAACATTTTGAGAATGTAAAAAAGCGATTGGTA TATTTGTATCCACTAGCATTGAAGAGTTTTCAGCTTCCCTTTTTATAACCAATTACTTACCCAAACACAG ATCGACCTGTACAACCAATTGTTAGGTGGTATATCGAGGAGGCTGGTACGGAAAAGATTAAAGGATTA AATGAAGTTCTAATTTGGCCATACAAAAAATGATGAAACCGCGCACATTATCGCATCTTACCACATA GGTTTATACCGTTATTCAAGCAAATATTATCTGATCGTAATACCTTATCGTTCATATTAGAGGAGTTTAA ATCTGACGAAGAAGTTATACAATCTTTTGCAAGTATACGGGATGTTAATAACAAAGAACAATGGCGCTATT AACAGCCGAAGCACTGTTCAGCACACTGTTAAACAGTAGAGATATCGACTTGACTGACTCATATTTTTATATCGACATAACGTAGG TTGAGACAATTCTTCAGCATTGCGATCACGAAGTCTGCTAAAGAGAAAGTGCAGAGATCCCTAAAACGA GGATATAAATTGCAGGTAAGATAAATTTCAGCTGCGCAGGTAAGATGTTCTCAAGCAAAGAC TTCCGAAATCTTGTCACACCGACACGCGCCATTAGAATCAACCTCTTACCCACTACTTTGAAAAACAAGAA GAGAAGGAGATATTAAAATCACAACTTGATTCTTTACTTGGCCTTTATCCAAGATTGACCCGTAAAGTTCGCTGT TGACGAGCAATGAAGTGATCCAGAGTTTTTCCCAAGATTGACCGGCTATAAAGTTGAAATGGAACC TTCGTTATCATTTACAACAAGCTAGGAACTATGCTACAAAAAAACCTTATTCTGTCGAAAAATTTAAA CTGAACTTCCAAATGCTCACTCTAGCAAGCTGGCTGGGATGTTAATAACAAAAAGAACAATGGCGCTATT TTGTTTGTAAAAATGGCCTATACTATCTTGGAATTATGCCTAAACAAAAGTCGCTACAAGGCTTTGT CATTTGAACCTACTGAAAAGACTAGCGAAGGTTTCGATAGAGTTCGATAGATGTATTACGATTATTTCCCGATGCCGC TAAAATGATCCCCAAGTGCTCTACTCAATTGAAGGCAGTTACTGCTCATTTCCAAACGCATACCACGCCA ATACTGCTTTCTAACAACTTTATAGAACCACTAGAATAACGAAGAAAATTACGACCTAATAACCCA GAGAAGAACAAAAAGTTCCAGACGCCCTACGGGACGCCCCAAAAGACAGGGACCAAAAGGTTACCCG AGGCGTTATGTAAATGGATTGATTTTACTAGGGACTTTTTATCAAAATACACTAAAACGACGTCTATTGA TCTTAGCTCCTTAGCCCCGTCCTCCCAATACAAGGATCTAGGTAGGTATTATCGCAGAGTTGAACCCGCTA TTATACCATATTTCCTTCCAAAGAGGATTATGCTACATCTCATAAAGAGAAATTATGACCGTGTTGAAACTGGGAAATTGT ACCTGTTTCAGATTTTATAATAAGGACTTCCGAAAATTTGGCTAAAACAAGGGTCACCATGGTAAGCCTAACCTTCACACTTTGTA CTGGACCGACTATTCTCGCCTGAAATTTGGCTAAAACAAGTAT GAATAACAAGTAAACGGTCAGCCGAGTT ATTTTATAGACCCAAATCTAGAATGAAAGAATGCCCATAGATTAGGCGAAAGATGTTAAACAAGA AATTAAAGACCAAAAAACCCCGATACCCTATACCAGACAACTGTCACTGTGAATCACA GGCTTAGTCACGATTATCAGATGAAGCAGGGCTTTATTGCCAAATGTCATCACCAAGAAGTATCAC ATGAAATAATTAAGGATAGAAGGTTCACATCTGATAAATTCTTTTCATGTCCCAATTACATTGAATTA ACCTGTTTCAGATTTATAATAAAGGACTTCCGAAAATTTTAATCGCGCGTCAACGCCTATTCTCACACTTTGTA CTGGACCGACTATTCTCGCCTGAAATTTGGCTAAAACAAGTATCAAGTTAAGCGGTCAGCCGAGTT ATTTATAGACCCCAAATCTAGAATGAAAGAATGCCCATAGATTAGGCGAAAAGATGTTAAACAAGA AATTAAAGACCAAAAAACCCCGATACCCTATACCAGACAACTGTCACTGTGAATCACA GGCTTAGTCACGATTATCAGATGAAGCAGGGCTTTATTGCCAAATGTCATCACCAAGAAGTATCAC ATGAAATAATTAAGGATAGAAGGTTCACATCTGATAAATTCTTTTCATGTCCCAATTACATTGAATTA ACCAATCATCGGCTCAACGATCTTTAAATACCATACAACAAGTTGATTATCAACAAGTTGGATAACAGAGA AATCCTGGAGCAACGATCTTTAAATACCATACAACAAGTTGATTATCAACAAGTTGGATAACAGAGA |

TABLE 6-continued

SEQUENCE LISTING

| SEQ ID NO: | Sequence |
|---|---|
| | AAAAGAACGTGTTGCCGCTAGGCAGGCTTGGTCTGTCGTAGGAACAATTAAGGACTTAAAGCAGGCTA<br>TCTGTCCCAAGTTATTCATTGAAGTAGTCGATCTGATGAATACATTATCAGGCAGTTGTCGTGTTGAAAAT<br>TTGAATTTGGCTTTAAATCAAAAAGAACTGGCATAGCAGAAAAAGCTGTACCAGCAGTTGAAAAG<br>ATGTTAATCGATAAGCTAAACTGCCTTGTTCTTAAAGATTACCCCGCAGAAAAGTAGGTGGTTGTTCTTA<br>ATCCATATCAGTTGACAGACCCAATTTACATCCTTGCGAAAATGGTACGCAAAGCGGTTCTTATTCTA<br>CGTACCGGCCCCCTATACTTCTAAGATCGACCTAACAGGTTTTGTGGACCCTTTGTTGAAGACG<br>ATAAAGAACCACGAGTCACGCAAACATTCTTAGAGGGCTTTGATTCTTGCACTGACGACGTGAAACT<br>GGTGATTTTATCTTACACTTTAAAATGAACAGAAATCTCTCTTTCCAACGTGGACTGCCCGGATTCATGC<br>CGGCTTGGGACATCGTTTTTGAAAGAATGAAACGCAGTTGACGCCAAAGGTACACCATTTATAGCGG<br>GTAAGAGAATTGTGCCGGTCATAGAAAAACCATAGATTTACAGGTAGATATAGGGATCTGTACCCTGCTA<br>ATGAATTGAATGCATTACTCGAAGAGAAGAATTGTGTTTCGAGATGGATCGAATATTTTACCTAAGTT<br>GTTGGAAAATGATGATTCACACGCAATTGATACTATGGTTGCCCTCATAAGATCCGTATTGCAAATGAG<br>AAACTCAAATGCTCTACGGGAGAGGATTATATAAACAGCCCCGTTCGCGATCTTAATGTGTTTGTTTT<br>GATTCACGTTTTCAGAACCCCGGTCAATGGAATGCCAATGGAACGGAGCATATCATATTGCTCTT<br>AAAGGCCAACTACTATTAAATCACTTAAAGGAATGCCAAAGACCTAAAATGCAAAACGGGATATCTAAT<br>CAGGATTGGCTGGCTTACATACAAGAACTACGTAACTAG |
| SEQ ID NO: 139 | ATGGCCGTTAAGTCAATCAAAGTGAAACTTAGACTGGATGACATGCCAGAGATTCGTGCGGGGTTATGG<br>AAACTTCATAAGAAGTTACGCCAGGGTAAAGCTGGTTATCACCGAATGGTTATCATTACTTCGACAAGAG<br>AATTTGTACAGAAGGTCCCCGAACGGCGACGGTGAGCAGTGAAGAACGGCGATAAGACGGCTGAAGAATGTAA<br>GGCAGAACTTTTGAGCGCCTGAGCCAGCTAGCTACAGCAATTGTATGAATTGTTGGTCCCTCAGGCTATTGGGAGCTTAAGGA<br>TGATGAGCTTTTACAGCTACAGTAGACAATTGTATGAATTGTTGGTCCCTCAGGCTATTGGGAGCTTAAGGA<br>GACGCTCAACAAATCGCCAGAAGTTCTGTCACCTCTGCTGCAAAGATGCCGTGGGAGGATTAGGT<br>ATCGCTAAAGCAGGTAATAACCAAGATGGTTAGAATGGCGCTGACAGAAACCGCAGTGTTTACGGCCTTGGCTG<br>AGAAGAAAGAAAAGCCGAAACTAGAAAAGCGCTGACGAGTGTATACTGATTCAGAAATGTCTTCCGTTGAATGGAAGCCCCT<br>AAGGAAGGGACCAAGCGGTCAGGGTATTAAGAGTAGGTCAAGAATACCGTAAGATACCGTAAACTGGTGAACAAAAGATAGATTT<br>CATGGGAATCTGGAATCAAGAGTAGGTCAAGAACATTGTGTTAATCAACTTCAAGAATGAAAA<br>GAACAAAAAATTTTGTAGGTCAAGAACATTAGTAGAACAGCACACTATGTTACCGCCGAGCTTTGCGAGGT<br>TCTGACAAAGTATTTGAAAGAAGAACACTAGACGTTTTGGATCCATGATCTCTATATGATGCTGAAA<br>TTAAAACGTTCAAAGAAGACACTAGACGTTTTGGATCCATGATCTCTATATGATGCTGAGC<br>CAGAATAACCAGGCTCTATGGCCTGAAGATGTTCTGTACATTCACCCTGCCATTGCAGTCTACCGCTCATCCTATTGG<br>ACTAGATTGACAAGTTGGGGGGAGATTCTACATCAGTAACATTTTATTAATGAATTCGGTGATGTA<br>AGACACGCTATTAGATTCCACAAGTCTACAAGGTTGCAAGGTTGCAGAGAAGGTTGATGATGTA<br>ACAGTTCCCATTTCTGATCTATGTCGGAGCAATTGGATAATCTATTGCCTAGAGACCCTAATGAACCAATTGCTT<br>TGTACTTTCGTGACTACGGTGCAGAACAACACTTTACAGGTGAATTCGGCGGAGCCAAGATTCAATGTA<br>GACGTGCAACTCCCACACATGCAGAAGAGAGGCGCTCGTGATGTTTATTTAAATGTGTCTTGTTA<br>GAGTTCAATCCAATCGAGGCTAGAGGTGAAAAGAACCACCATACGCAGCAGTTTTTAGGTTAGTAG<br>GTGATAATCATAGGGCATTTGTCCACTTGACAAATTAAGTGATTATTTTAGCAGAGCACCCTGATGATGG<br>AAAGTTGGCAGTGAGGATTATTAAGTGGTTGAGGGTAATGTCTAGAATCCTAATAGCAAAGGAAGAGTCCCG<br>GCGAGTATCTCTGTCTTTAGGATAGCACCTGAAGGATGAGTTGAACCTAATAGCAAGGAAGAGTCCCG<br>TTTTTTCCTATTAAGGTAACGATAACCTGGCCTGCGACAGAAGATCACAACTTTTGAAATTGC<br>CAGGAGAACGGAGTTCAAGGACTTGAGGCAATTGAGGGACAGTTAGGAGACAAGAACTCAGCGTACATGCGAACAGCTG<br>AGAACTGCTATTAGATCCGAGATTTGAGGTTGTTGGTTAGGTGTTCCGAGAGTTGGCAGAATGGAGAGAAAGG<br>TCTTGGCCAAATTGATAGAACAACCCAGTGACGCCGCAATCACATGACACCAGATTGGAGAGAAGCT<br>TTCGAAAATGAACTTCCAGAATTCCAGAATTAAAGACCTACATGGCAATGGCAATATGCTCTGATAAAGAGTCGATGATAG<br>GTATACGAATCCGTTCGTAGAGTCTGGCGCCACATGGGTAAGCAAGTGGGGACTGGAGAAGGATGTT |

TABLE 6-continued

SEQUENCE LISTING

| SEQ ID NO: | Sequence |
|---|---|
| | CGTTCCGGCGAAAGACCGAAGATAAGGGGTATGCAAAGACGTTGTAGGCGGTAATTCTATTGAACA |
| | GATTGAGTATTGGAAAGGCAGTACAAATTCTTAAATCCTGGACTTCTTCGCAAAGTGTCAGGACA |
| | AGTCATCAGGGCTGAAAAAGGTTCCAGATTGCTATTACGCTAAGGAACATATGTCAGACTTGATGA |
| | AGATAGACTTGAAAAAACTAGCAGATAGAATAATTATGGAAGCACTTGGTTACGTCTATGCACTTGATGA |
| | AAGAGGCAAGGGGAAATGGGTAGCTAAAATCACCGCCTTGTCAACTTATTTATTAGAAGAATTAAGCGA |
| | GTACCAATTTAACAACGATAGAACCTCCATCGAAAATAATCAGCTGATGCAATGGTCCATAGGGGTGT |
| | TTTTCAAGAATTGATAAAATCAAGCTCAAGATACTCAAGCTGGTAGGTACTATGTACCAGCGTTTTCG |
| | AGCCGTTTGATGCAAGAACTGGTCGTGCCCCAGGTATCAGATGTCGACGTGTTCCGGCCAGATGTACACAG |
| | GAACATAACCCTGAGCCATTTCCGTGGTGCTTAATAAGTTTGTTGTCGAGCACACATTAGACGCATGCC |
| | CTCTGAGACGCAGATGACCTTATACCCACTGGAGAAGGCGAAAATATTTGTTAGTCCATTCTCTGCAAAG |
| | AAGGTGACTTTCAACCAGATACATGCAGTAAATGCAGCTAAAATCAGTTGTCTTAGTGCTGTGTCGG |
| | ATTTTGATATTTCGCAAATAAGACTAAGATGCGATTGGGGAGAGGTTGATGGAGAGTTGCTGTCGATTC |
| | CAAGATTAACCGGAAAGCGAACTGCCGATTCCTATTCTAACAAGGTGTTTTACACAAATACTGTGTTAC |
| | CTATTACGAAAGAGAAGAAGGGGTAAGAACGACGTAAAGTATTTGCTCAAGAAAAAATTGTCAGAAGAGG |
| | AGGCAGAACTGTTAGTAGAAGCAGCAGCGTAAATGCAGAGAAAATCAGTTGCTTATGCGTGACCCTTCCG |
| | GCATTATAAATCGTGTAATTGGACACGACAAAAAGAATTTTGGTCTATCGTCAATCAACGTATCGAAG |
| | GCTACCTAGTTAAGCAAATCAGGTCTAGGGTTCCACTACGAAGATAGCCATGTGAAAATACGGGTGATA |
| | TATAA |
| SEQ ID NO: 140 | ATGGCTACTAGATCTTTCATTTTAAAAATTGAACCTAATGAAGAAGTGAAGAAGGGTCTCTGGAAACT |
| | CACGAAGTACTTAATCATGGCCATTGCCTATTATGAAGAATATCCTGAAGCTTATTCGTCAAGAAGCTATAT |
| | ACGAGCCATCATGACCAAGATCCTAAGAACCCTAAGAAAGTAAGCAAAGCGGAAATTCAGGCTGAATTG |
| | TGGGACTTCGTCTTGAAGATGCAGAAGTGTAACAGTTTTACGCACGAAGTTGATAAAGATGTGTGTTT |
| | AATATTTGAGGGGACTATATGAGAGTTCCTCGGTGCCCTCGAGTGTCAATCAGGTAAGGCACTGCCAGTAGTG |
| | CTGTCAAATAAATTTTATATCCTCGGTGGATCCAAACTCTCAATCAGGTGATCCATCGTGGGAAGAGTAGTG |
| | TGGGAAAACCGAGATGGTATAATTGAAATCCCCTTGCCAAAATACTAGGTAAGCTAGCCGAGTATGGACTTAT |
| | ACCATTATTCATTCCTTTCACGACTCTAATGAACAATTGTGAAGAAATCAAATGGATGAAAAATC |
| | ACGTAATCAGTCTGTTGAGGAGGTTGGACAAAGATATGTTTATACAGGCTCTTGAGAGGTTTTTGTCGTGG |
| | GAGTCCTGGAATTTGAAAGTGAAAGAATATTGAAAGAACAGTACGAAAAAGAAGAAGCATAAGACGTTGAAGA |
| | AAGGATTAAGGAGATATTCAGGCCTTTAAGACTGGAACAGTACGAAAAAGAAAAGAAAGCAAGGAACAGT |
| | TATTGAGAGATACTCTAAACACTAAGATTAATGAATAGGCTTTCCAAGAGGCCTTGCCAGGATGGAGGAGA |
| | TAATTCAGAAGATACTCTCAAATGGAAAATGGAGAACGAGCCATCGTGTTTATGAACAGTGAAGAGATT |
| | ACCAAGAAAGAACACCCTCGCGAAGCTGGTGATTACTCGTTATATGCTACATTTTGCGAAATTGACAAGAAAA |
| | ACTTCATCTGGCGAAATCATCCAGATCACCTGATCCGTATGCCAATCACACCCCATTATGGGTCAGGTT |
| | AAAAGATGCTAAACGAAGCAGACATTCACCCTCGATCCGATCAACCACCCCATTATGGGTCAGGTT |
| | CGAAGAGAGATAATCAGGCTCGAACTGAATAAGCTACAGATGATTATCCAATTTTACAACAAATTTCTGGATCGAAGTT |
| | AAAAGAGAAATTGACGGTCAACTTGACAGATGAGAGTATTATCCAATTTTACAACAAATTTCTGGATGAGAGAA |
| | AGGTAAGGTTGATATTGTCTTACCTATAAGGATGAGAGTATTTAAATTTCCATTGAAGGAACGCTTGGCGC |
| | AAGGTAAACATGCTTTTACCTATAAGGATGAGAGTATTTAAATTTCCATTGAAGGAACGCTTGGCGC |
| | GCTAGAGTTCAGTTCGATAGAGATCATTGAAGAAGATACCCGCATAAAGTGGAATCTGGTAATGTAGGT |
| | CGGATCTACTTTAACCATGACGTAAATATTGAACCTACCAGTCACCAGTAAGTCTTTAAGATTC |
| | ATAGGGATGATTTCCCTAAATTGTCAACTTCAAGCCTAAGGAACTAACCGAGTTGGATCAAAGACAGTA |
| | AAGGCAAAAGTTAAGAGCGTATTGAGTCCCTGGAGTAGGTCTTAGAGTCATGTCTATCGATTTGG |
| | GTCAAAGACAAGCAGCCGCAGCATCTATTGTCAAGTTGTTGACCAAAACCGATATCGAGGGAAAT |
| | TATTTTTCCAATAAAAGGAACTAGAGACGTCTTGCATTTCGAAGTGGCGTAAAGCAGTTCGAGCATAAAG |
| | AGAAACACTAGTAAATTCCTTAGGAGCTGTTCCATTCCAACAGTTTAATAATCTCAAATTAATGAATCA |
| | GAAGTAAATTTCCAATAACGATCTCAAGACACAAGAAATAGTGATGTCCATTAGTGTATCAAGACGAACTTATTCA |

TABLE 6-continued

SEQUENCE LISTING

| SEQ ID NO: | Sequence |
|---|---|
| | AATAAGAGAGCTAATGTATAAACCATATAAAGACGTGGCTGGCATTCTTAAAACAATTACACAAGCGGCT<br>TGAAGTAGAAATAGGAAAAGAAGTAAAGCATTGGAGGAAGAGTCTGTCCGATGGTCGCAAAGGCCTGT<br>ACGGGATATCACTTAAAAATATTGCAGAAGAAGTTGACAGAACCGAAAATTTTGTTAAGATGGTCATTGA<br>GACCAACCGAACCAGGTGAGGTTAGAAGTTGGAACCAGGCCAAAGGTTTGCCATCGATCAATTAAACC<br>ATCTTAACGCACTGAAAGAAGAGATTGAAGAAGATGGCAAGAACCCTGCGAACCTATTATTATGCACGCTCTAGGTT<br>ATTGCTATGATGTGAGAAAGAAAAAAATGGCAAGCCAAGACGTCAGTTTACCATCGCCAAATTATTTTGTTTGAAG<br>ATCTTTCTAATTACAATCCTACGAAGACGCGTTACGTTTGAAAACTCTAAATTGATGAAATGTCTAG<br>AAGAGAGATTCCGAGACAGGTCGCTCTACAAGGGGAGATTTACCGTCTTCAAGTCGGTGAGGTTGGTGC<br>TCAATTTTCTTCCAGATTTCATGCAAAAACTGGGTCTTCCAGGCATTAGGTGTTCGGTCGTTACTAAGGAA<br>AAGTTACAGGAGCAACCGTTTCTTCAAAATTTGCAACGTGAAGGCCGTTTAACACTTGATAAGATAGCT<br>GTCCTTAAGGAAGGCGATCTGTACCCAGATAAAAGCTGGTGAGAAATTCATATCTTGAGTAAAGACAGG<br>AAACTGGTTACAACACGCCGACATTAACGCAGCTCAGAACTTGCAAAAGAGATTCTGACAAGGACC<br>CACGGCTTCTATAAGGTGTACTGTAAAGCTTATCAAGTAGATGAGGACAAACGGTTTATATTCCTGAATCAA<br>AGGACCAGAACAAAAATATAGAAGAATTTGGTGAAGGATATTTATCTTGAAGGATGGAGTTTATG<br>AGTGGGCAATGCAGTACGTAAGTAAAGAAAAGAGGTTCATCAAAGCAATCAAGTAGCGAACTGGTC<br>GATTCGGATATTTTAAAGGATAGCTTTGATCTAGCTAGTGAATTGAAGGGAGAAAGTTAATGTTATAC<br>AGAGATCCCAGTGGGAATGTATTTCCATCTGATAAGTGGATGCGCCGGAGTGTTTTTTGGCAAATTAG<br>AGAGAATCTTGATTTCTAAACTGACCAATCAATACTCAATTTCGACCATCGAAGACGACTCTTCAAAACA<br>ATCCATGTGA |
| SEQ ID NO: 141 | ATGCCTACTCGCACCATCAATCTGAAGTTAGTTTGGGAAGAACCCAGAAAATGCGACTCTAAGACGG<br>GCACTATTCCTACACATAGACTTGTCAACCAAGCACTGTAAGAGAATTGAAGAATTTTACTGTTGTGTA<br>GAGGAGAAGCTTATCGTACCGTAGAATGAAGGTAAAGAAGCTGAGATCCCACGCCATGCTGTTCAAG<br>AAGAGGCGCTTGCTTTGCAAAAGTGCACAACGACATAACGGCTGTATCTCCACATATGAGGACCAGG<br>AAATCTTGGATGTGCTTAGACAATTCTATGAAAGATTAGTACCTAGCGTCAATGAAACAACGAGGCTG<br>GGGATGCCCAAGCCGCTAACGCTTGGGTAGTCCGCCCAGTAGTGCAGAGTCCGAAGGTGACTATCGG<br>TCTATGATAAAGTGTTAGACACGTCCGACGAGGTCAATCGCTGCTAAATAAACCGGGTAGCCCAC<br>AAGCTGTTCTCAGATTTGGATACAGTCCACGAAGGATGTCAACCTGGCCAAGATGACTTCGTTTCAGACCCAAAAAAAA<br>AGCAAGATGAACTAACGAAAGGTAACGCACCACCTCATAAAACAATTGAAGGAGATGGGCCTCTTGCCTT<br>TAGTTAATCCCTTTTTTAGACATTTGTTGGATCCGAGGGTAAGGGTGTATCCCCATGGGACAGATTGGC<br>CGTAAGGCGCCGGTGGCGCACTTCATCTCTTGGGAAAGTTGGAACCACAGAACAAGAGCTGAGTATAA<br>CAGTTTGAAACTGCCAAGACGTGCAAGATGAATTTGAGGCCCCATCTGAAGTCAATTCAAGGACGATTTTACATTGCT<br>ACGACAATATGAGGCTAAGCGACATAGTACGCTTAGTAGCTTCAATTGCCTTAGCTGATGACTCTAACCGTA<br>CCGAATTGGTTGGTAAGGTCCTTGACGGTTACCATCCTTAGTAGCTTCAAACACAATTACGGGTAAATTCGGTGATCCAG<br>CCGAGGAACAAAGGGTTACCATCCTTAGTAGCTTCAAACACAATTACGGGTAAATTCGGTGATCCAG<br>ACCTATTTAATTGGCTAGCCCAAGATAGACACGTACACCTGTGCTCAAACCTGTGTCCCCGAGAGTTCCCTCACGCCCT<br>CGTAAGGATTAATGCCGTGCACAAAGTGCTTAGAGACGTAAGCCTTATGCACTGATGACTTTTGCACA<br>TCCGAGATTCCATCCAAGATGGAATTCTACACTTCCATTATACGACGCGCCTGGTGGTTCTAACCTTGCACAATACCTTTA<br>GATTGTACTGAAAAATGCTCTGCATATTACACTTCCATTATCGTCGACAGCCCATGGTACAATGGATTG<br>AGAAAAAAAATCCGCGCTACCACTCGCTCTAGTGGACAAATACAAGATTTAACTTTAGAAAAAACTTGAAA<br>AGAAAAAAACAGATTATACTATAGATCAGGATTCCAACAATTTGCTAGAAGAATCTCTGTTGGAAGGCCAGGCG<br>CTGTGTGGTTCATAGGCCGTATATGGAACATGATGAGAGATCAGAAGAATCTCTGTTGAGAAGGCAGGCG<br>AGTTAGGACACCTCCAATTAACCTTAGATGTTGCTACCCAAGCACCACCTAACTGGTTAGAGGTAAAGCAG<br>CTTGCAACCAGGATTGAGAGTCCTTTCTGATGATTGGTATGAAGAACATTTGCTTCTGTCTGTTTTCG<br>AATTGATCGAGGTAAACCTGAAACAGGTAGAGCATTCCCTGTTGCTGACAAAGATCAATGGATAGTC<br>CAAATAAGTTATGGGCCAAGCAAGCATTGCTAGGCAGATTACGCCTGCAGGATTACCTGCCCTGAAAACACCGAGCAGA<br>AAGGAGGAAGAGAAGAAGCATTGCTAGGCAGATTACGCCTGCAGGATTACGCCTGAAAAGAGATATTCAAAGACT |

TABLE 6-continued

SEQUENCE LISTING

| SEQ ID NO: | Sequence |
|---|---|
| | GAAATCACTCCTAAGATTAGTGAGGAAGATAATGATATATAGAAGAGAGATGCTTGTTAGAGCAATTCTT<br>TAAAGGAGTGGGGTGAAGAGACAGTAGTTCTGGTTCAAGCTTTCCTAGAAGCTTCTTTCAGGGATTAGG<br>CGCTGCACCCTTTAGTCAACACCCGAATTGTGGAGACAGCACTCAGCGTATTACGACAAAGCGGA<br>AGCTTGCCTGCAAAGCATATTTCCGACTGGAGAAGAGAACTAGAACCTCGTCCGACTTCGAGAGAGAT<br>GTGGTATAAGACAAGATCTTACCATGGTGCAAAGTATTGGATGCTAGAATACTTAGATGCTGTCCG<br>CAAATTACTACTTTCATGCTCGTTAAGAGTCGTACTTACGGAGCTATTAATAGACAAGACACCGCTCGT<br>TTTGGTTCCTTAGCTTCTAGATTGTGCATCATATACTCTTTAAAGGAAGACCATCATCAAAACCGGTG<br>CAGATAGTATTGTGCAGGCCGCAAGGGCTATATTCCTCTCCACATGGCAAGGGTTGGGAACAGCGTT<br>ATGAACCCTGTCAGTTGATATTATTTGAAGATCTAGCTAGGTACAGATTTCGTGTAGACAGACCTCGGAG<br>AGAGAATTCGCAATTGATGGAATCATCGAGCTATAGTAGGCAGAAAACGACGATGCAAGCTGAACT<br>ATACGGTCAAATAGTCGAAATACCGCTGCTGGTTTCTCCTCAAGATTTCATGCTGCAACTGGTGCTCCT<br>GGTGTCAGATGCTGCTTTTTGTTAGGTAACAGAGATTTCGATAATGACCTACCAAAGCGTACTTACTGAGAG<br>AACTAAGTTGGATGTTAGGTAACACAAAGGTTGAATCAGAGGAAGAAAATTGCGCACATTACACCCGAAAAGAC<br>AAATTAGACCAGGTTCATAGTCCCTTGGGATGGGGTGAACAATTCGCGACATTACACCCGAAAAGAC<br>AAACTCTTTGTGTCATTCACGCAGATATGAACGCTCAAAACCTGCAACGCAGATTTTCGAAGGTG<br>TGGGGAAGCCTTTCGGGTCATCAGCCACATGGTGCAGCGCTTTGAGGCTAGCGTCTACACCAGGT<br>GCAAGACTTTTGGGTGCATTACAACAACTGGAAAATGGTCAGGGAGCTTTCGAATTAGTTCGTGATATG<br>GGTAGCACATCACAAATGAATCGTTTCGTCATGAAGTCGTTGGGCAAAAAAAAGATCAAGCCATTACAA<br>GACAATAACGGGATGATGAACTAGAAGACGTCTATCTGTTTTTACCTGAAGAGATGATACCGACGA<br>ATTACTGTATTTCGGGACTCTTCCGGTATATTCTTCCCTTGTAACGTTTGATCCCGCAAAACAGTTCTG<br>GCCTGCGGTCCGTGCTATGATTTGGAAGGTTATGGCATCACCAATTCATTGGGTTAG |
| SEQ ID NO: 142 | ATGCAAAGTTAAGGCATAGACAGAGAAGTTAACTGCTACGATTCACGATTGGGCGGCTGTCTAAAAAGAGAGAAGT<br>TCTAGGGAGCAATGGTAAATTACAGACGTAATGCGTCAATAACAAAGGTCAGGTGACAGAATT<br>TCGAAAAGCATTTCCGCATACGCCCGAGCAACCAAAGGGGAAATGACGATGCAGAAAAATATGT<br>TTACTCACTCATTTGAACCATTCAAGACCAAGACCCTTCGTTACATCAGTGCGAACTGGCTGACAAAGCCTA<br>CCAGAGCTTGCATTCATATTTACCGGGTTCTTGGCCGCATTTCTTTATCTGCCCATGCACCTTGGTTTA<br>GGATTTTAGCAAATCAGGGAGCACTGCTCATTCAAGCGCTCCTCAAAGATTGAAGCTTACGAAAGCA<br>AGTTAGCTAGCGAGCTTGCTTGTGATTTGTCTATTCAGAACTTGACTATTTCAACTTTGTTCAACGCA<br>TTAACGACTTCCGTAAGAGGTAAAGTGAGGAGACATCGGACGGCCCAGAACGAGATTTAGCCGAGGTGATAAGC<br>AGAAAATTGCAAGTTCTTTTGAACTTGGAACGAGAGATGACTGCCAATCCACTTCAATCTCTTCAATTTT<br>TTGAAGAGGAGTTGCATGCCGCTAGATGCAAAATGTTAGTTTGTCACCTGCCTTCGATGCTCCTGTGTTTAAGAT<br>GAACGACCTGCAGGTGACTTGAAGAACAGAACGATAGTTTTAGTTTGTCACCTGCCTTCGATGCTCCTGTGTTTGAATA<br>TAATGCTGAGGATCCTGCTGACATCATCATCATTAAACTGCAAGCTAGATATGCGAAAGAAGCAGTGATTAA<br>AATCAAAATGTCGGGAATATGTTAAGAACGCTATTACGACAACTCAAGACCAAACGACGACGCAGTAA<br>GCTGAACAAAGGCCCTTTCTAGCTGTCATGCGTTGATAGAACTTATGCTCAGTTAGAAGCACCTGAGTTTATTGGAGTCGAG<br>AGATCCCATCCTAGCTGCTAGAACTGTGCTGAAACTGCTCAAGGTATGATAAGCACCTGTAAGCAACTGTTCGAAA<br>AAAATGTTTTTTCTGATACTCGTTCCGAGGTTCAAGGTATGATGATGAATATCGC<br>CAGGCTGCTCAAGCTCTCGTAATTCATTGAGCATGAGGAACTTGAGAGATTGATAAAATCTTTT<br>CAAATTCATACACCACCATTGTTCATTATTTATAGGCCTCAATCCTTATCTGCTCAACATCAATGGAAAGCCTAC<br>CCGAAGCAATTGCAGTCAGGAGTGAACAGTGCTGATATTCTGCTGATATCAGAGAATTAACTACCTCGCCTC<br>ATTTCTTTGGTCGAGAGGAGTCAATCGCTACGTATCAGATAAGGCTATAGGAAGAGAATACATTTACCGCTGC<br>TGCAGGGACAGATTAACGGCTGCTATTAAGAGGAAAGCTATTGATGGTGAGAAGATCCATCTACCTCGCCT<br>TTGGTCAGAGTTAATTCTTACCCTTTAGTGGGCAACCAGTGCGATTGATGTGAATCAGATTAGCCCACT<br>TAAAGAACCAATACCAGACATTGCCTAACGAATTTGATACGCTGATTTCCCACTGCAAGAGAATTTCG<br>ACTTAATTTTAATAAAGCCTGCTTATGCTTAGTTAGAAACATGTGAGGCTATGTGTAGATCAACAAAA<br>AGAATGCCCTTCTAAGCCTCGAGATCGTTAGTTATAGAAGTACTGAAAAAAGCACAAGATATTTGAGTCCAAC<br>AGGGGCTCTCAGTCTTGAGAGGGGCGGGTATAGACGGGTATAGAAAGCACAAGATATTTGAGTCCAAC |

TABLE 6-continued

SEQUENCE LISTING

| SEQ ID NO: | Sequence |
|---|---|
| | TCTGAATTAAGAGAGCACGTTCATGAATGAAAGAAAAACACTTCGTATTGTTCTCCCGCTGATAGAAAGCC<br>AAGAAGCTCCTACGTTGACTGACTCTAGGCCTCAGCCTAATTATTGCACGTAATTGATGAAATACTACACATG<br>ATAATTTAGAGAACAAGGATAGAGAATCTTTGTGTTAGTTCGACTCGGTTATTACTGGCCGGCTACC<br>AGACCAACTCTCCTCTTCCTTCTTTATAAATCTTCCAATCATTAACTCAAAAGGCGATCGTCGCTTGATAGAT<br>CTCATTCAATACGACCAAATTAATAGAGATGCTTTTGTGATGTTGGTAACTTCCGCACTTTGTCACCATATTGGG<br>TAAGTGGGCTGCAGTACAGAGCAAACAATCAATCTTTTGTGGTTTACGCGCCACTTTGTCACCATATTGGG<br>ATCTAAATTGGTTTATGTGCCAAAGATAAGATTGGCTGTCCTTCCCAATGTTCGAGGAGATTT<br>GCGGACATTTTGCAATCCGATTATATGCTGTGGAAGGACGCTGAAGAATTGTGTGTTATTGACACAGCT<br>AAGCATTTGTCTAACATTAAAAATCTGTATTCTCAAGTGAAGAAGTCCTCGCGTTTTAAGAGAATTGC<br>CACACCGTACGTTTATCCAAACTGAGGTCAGGGGTTTAGGGGTGAATGTGACCGTATTGCATTTAATA<br>ACGGGGATATACCCTCTCGAAGACGTTTGCGTGCAAGTCAAGTGAGTCGGACAAACACTA<br>GTCTGGTCCAAACATTAAATAGATGGTTTGAAGGCGGTAAGGCTCTCGCCCCTAGCATCCCAATTTGAGA<br>GAGCATATTACAAAAAAGATGATCAATCCAGGAGGACCGTCAAAAGGAAGATAAGGTTTCAAATG<br>CCAGCTACAGAGTTGGTACACGCGTTCAGACGCCAGGATGGACCTCCGTATTCGCAAATGGAGTATCGATC<br>CCGGTGAATATGGTATGGGTTTGTCATTGGTCTCAATAAATAATGGCGAAGTTTTAGATAGCGGATTTAT<br>ACACATAAATTCATTGATAAATTTCGCTTCTAAGAACATCAAATAAAGATTCTGCAGCAGGAGACATAGCTCA<br>GCAATACAAGTCACCATACGCCAACTATCTAGAACGCCCTACCCGTTTCGAAGCGTTTCGAAGCTCTATCTGGCAATAGTCAA<br>TATTTTGGATAGACTTATCTACAAGTTGAACGCCCTACCCGTTTCGAAGCTCTATCTGGCAATAGTCAA<br>AGCGCAGCCGATCAGGTTTGACAAAAGTCCTCAGCTTCTACACCTGGGAGATAATAATGCACAAAAT<br>AGTTGAAGATTAGAATTCAGAAATTCAATTGTTCAGACTGACTATAAAGTTATTAATCCAGACCCGTC<br>AACGCATGAGAACAAGGAAGAGACATAATTAGGCGCATCAAGAATTCCTAGCTATAGAACTTCAA<br>AAATATAAGTCCAAGCTCACTAGAATTCAAAGAACTCAGTAGGTAGTGAGTACTTTGTCTTATAGTGATTGTAATTCCT<br>CCAGAATTTATTGCTAAAAAGAGGTAGGTAGTGAGTACTTTGTCTTATAGTGATTGTAATTCCT<br>CCTTAAATTCAGAAGCAATGCGGCTGCGAACGTGCCCAAAGTTCCAAAAGCAATTGTTTTTCGAATT<br>ATAG |
| SEQ ID NO: 143 | ATGAAAGAGATCTTGAACTCTTTAAAGGTTGCCGCCTCGCGTTTGTTATTTAGAGGTAAAGGATCGAAC<br>TTGTCAAGACTGTTAAATACCCTTTGGTCTCCGCCGGTTCAGGGTGCAGTTGAGGAGTTAGCTGAGGCGAT<br>CCGCCATGATAACCTACACTCGTTTGGTCAAAAGAAATTGTTGACCTTATGCAAAAAGGATGAAGGTAC<br>GCAAGTTTACTCAGTGGTTGATTTCTGGTTAGATACCCTCGTTTGGGATGTTTTCAGTCCATCAGCAA<br>ACGCATTAAAAATCACGCTGGGTAAGTTAATTCTGATCAGGTTAGCCCTTTAGGAAAGTGTTAGAGCA<br>GTCTCCATTCTCTTGGCTGTAGCGCTGAAGGTTGAACCCGGCAGAACGTATATTATCTGTCGAGATCCGT<br>AAGATTGACGAGAGGGAAAACAGTCAATACAAAATTAGCTAATGATAATCTGGGATAGTAAAGATCATGA<br>AGAGCAAAGAATGTTAAAGGCAGATTTCTCGCTATCCCTTTGATTAAGGATCCAAAGGCTGTGACCGA<br>AGAGGATCCTGAAAATGAAACTGCTGGTAAACAAAAACCCTTGGAACTTGTGTGCCCTTGTCCAGA<br>ACTTTACACAGAGATTGCCAGAAGATTGTTTAAGAATTTGTTCAACGCTAACTCTTTTAAGGGATAAA<br>ATGTCTACAGATACTGCCAGAAGATTGTTTAAGAATTGTCAAGGCGATGATTTGAGCAGATATTTCCAATTATGT<br>AACTCATTGTTGGAACGTCTTGGCAAGGGAAGGAAGATGTTTAAGAGAAGATTGAGCAGATTGCGCA<br>AAGTGAAGAGGTTACCGAAACCAAAATTTGCTGCGAATGCTCGGCATCATAAGGGATGTTCTTGCATGGCC<br>AATTGAAGTCTTGGTTCACTTCAAATTTTTAGACTATTTAACGACACTATCATATATGAAGAGGAAGTCTAGAGTCTATTAA<br>GTCAGATATACAATGCCACACATGCTAATATCATCATATGTAGAGAGAAAAGGTGTTATCATCCTCAATT<br>ACTTAGTCAATATGACATATTCGAAGCAGTTGCTCTTATAAGCACAACTACCAGCTTGCTACCAAGGTATTGCATGCTTATTA<br>TGAATGACACATATGTCGAAGCAGTTGCTCTTATATAATGATACATAAATCTGTGCGGTTTTTA<br>CCGGATTTATTAGATCATTAGAATCATAGAGACAAGGATCGTGAGTTTCTGCTTAGTATTTTCCAAGAATCC |

TABLE 6-continued

SEQUENCE LISTING

| SEQ ID NO: | Sequence |
|---|---|
| | CAAAAATTGATAAAAAAACCAAGGAAATTGTAGCTTGGGAACTGCCGGAGAACCAGAGAAGGTTAT<br>TTATTTACTGCTAATAACTTGTTCAGAAACTTCTTAGAGAATCCGAAACATGTCCGAGATTTATGGCCG<br>AAAGATACCCAGAAGAATTGACTCGATTACGCTCTGCTCCTGTCTGGTTCGGTTGATGAATGTAAAACAAT<br>GGCAAAAGTCGTTAACCAGTTAGTAGAATCACCAGGTGCTTTATATCAATTAACGAATCCTTCTTGAG<br>ACAAGGTTACAGGCCATGTTAACTGTGTAGATTTTTGGTTGGGACTTACAAACTGAAAAATTCTTAAACTTT<br>GGCGGATGTTTGTAGGCCTCTTGAATGATATTTATTTTAAGAGCTGTC<br>AAGACCAAGAAAACAATGCAAACGTTATTCCTCTGTCTTCCGGCAGATGTCTATACTGCTTGCGA<br>AGGTTTGGCCGATTAGACTTAGGGAGGACATTAGGATTCGAATGGAAGAATTTGAAAGGTCACGAGAGAG<br>AAGATTTCTTAAGATTGCCACCAGTTATTGGCAATTTACTTTTCTGGATTCGTGATGCTAAATTGGTAGT<br>AAAATTAGAGGATTGGATGAACAACCATGTCTTCAGGAATATGTAGAAGCCCGGAAAGCTATCGATCT<br>TCCACTAGATATATTCGGTTTGAAGTGCCTATCTCTGAATGCTATCTATTCGGAGTTGAGACAA<br>TTAGAACTTTTGCTTAGGAGAAAAAGTGTGATGACTAGCTACAGTGTAAAGACTACTGATCTCCTAAT<br>AGGTATTTCAGCTAGTTTATTACCTCTAAACCTAGTGACCCCGAAAAGAAGAACTCAAATAACTTTC<br>AAGAACGTTTGGATACCCCAACTGGTTTGTCCCGTCGTTTCCTAGACCTAACCCTTGATGCATTCGCAGG<br>TAAGTTACTTACCGATCCAGTTACCACAGATTGAAGACCATATGGACAGTTTTTTACGAGCATCATCTTTTTGA<br>TTCAAATGCCATGTAAACTCGCCGCCATGTGAATCATCCAGGTTCTTCTTCAAAGATGTTGTGTATT<br>CGAAACCCAAAAAGGTGTTGCTTCTAATATAGGGTTTGAACCGATCCCAGATCCCGCTCATCCCGTATT<br>TAGGGTTAGATCCAGTTGGCCAGAGTTGAAGTACCTTCGAGGGGCTATTGTATTTGCCAGAAGACACACC<br>TTTGACCATCGAATTAGCAGAGACCTTCCGTATCGTGCCAAAGTGTCTCGTCAGTTGCATTCGATTTGAAA<br>AACTTGACACACGATCTTAGGTCGTGTGGGAGAATTCTTTATTGTGTAAAACTTATTTGGGTCTCGACGCGGGTGAAAGG<br>CCTATAATCCGGAGAAAGAAGAATCTTTATTGGACCGGAGATGGGTACGAAGTGCAAAGATTGGGGTCCAC<br>AGCGGCGTCGGTTCGCTATTGTTACAGTGGACCGGAGATGGGTACGAAGTGCAAAGATTGGGGTCCAC<br>GAGGATACACAGCTTATGGCCTTGCCAAGTTGCTAGTAAATCCTTAGTAAAATCCTTCAGCCT<br>CTAAGAAAAGCCACCTTTAGACAACAAGAGAAGAATACGGAAATCCTTACGTGGTCTACTGGAATTT<br>TATCATGCCTTGATGATAAAATATAGGGCCAAAGTAGTACATGAGGAATCTGTCGGAAGTAGTGTCTT<br>GTGGGTCAATGGTTGAGGGTTTCAGAAGGTTCAGAGAGGTCCTCAGCTCAAGACACTCTTTGGGGTGCTTTCT<br>AAAAACGTGTAGATAAGAGAAGACAGATTGCGTTTGAGGTGCAAGCTGCAGGTTCTTCGCAATTTGTTGAAGTGC<br>GGATGGTGGTTCCAACTAGGCATGCGTGAAGTAAACAGGGTACAAGAATTCGGGCGTCGTGTTAGATTGG<br>AATAGAAGCATAGTTACCTTTTAATAGAATCATCCGGCAAAAGTTTATGGTTTCTCCCACAGCAAT<br>TAGAGAGGTTTCAGACAGAGACAGACATCGAAACTTTTAAAAGATGGTAAGACTTTATGCCGATAAG<br>TGTTTGATAGAAAAGGCAGACCGGCCGCTTACGTAGACCCGACATCGAAGGT<br>ACAGGTTTGATAAAGTATTTGAGAGAAGATTTGGGAGGTCTGCTCTTTTCATTTGTCCTAGAGTAGGTTG<br>TGGAAATTTTGACCACAGCTCGAACAGTCCGCGGTTGTTTTGGCCTTGATCGGATATATTGCCGATAAG<br>GAGGAATGTCAGGTAAGAAGTTGGTTTATGTACCGCTGGCCGAACTTATGGCCCGAATGGAAACTAAAA<br>AATTAGAAAGATCCAGAGTTGAAGAACAATCATCCGCTCAATAA |
| SEQ ID NO: 144 | ATGGCAGAAAGCAAACAAATGCAGTGTAGGAAATGTGGAGCTAGTATGAAGTACGAAGTCATCGGTTT<br>GGGTAAAAGTCATGTAGATAGTCGTCCGATTGTGCCAACCATACCTCGGCAAGAAAGATACAAAA<br>CAAAAAAAAGAGATAAAAATATGGTCAGCCAGTAAGCCCAATCTCAAAGAATTGCTGAGCAG<br>GTGCTCTTTACCCTGACAAAGTACAAACTATCAAAACCTATAAATCAGCAGAGACTTGAATGGTG<br>AGGTGCATAGACGGTGTTGCCGAGAATCGCACAAGCAATACAAGAGGACCAGAGATTGGACTTTTG<br>GACCAAGCTCAAGAATATGCATGCTGGATTGCATCTCAAAAACAGTCTGAGCCTTACAGTGTAGTCGAT<br>TTCTGGTTTGATGCAGTGTGCCAGGGAGCTCTTCGCCTACTCTGCCGCTAGATTATTGAGTACAGTTT<br>TACAGTTATCCGGTGAGGAATCGGTTGCTTAGAGCTGCCTTAGCCTCGTCCATTCGTTGACGATATAAA<br>CTTAGCGCAAGCCAAAAGTTTTTGCCGTTAGCAGGCCTACAGGTCAAGATAAGTTAGGTAAGACATAAA<br>TGGGGAGTGCTTTGCAGAAGGAGATTGGAAGCTTTAGGGATAAAAGATAGAAGATATTCGTATAAGTCA<br>AGCTATCGATGTTGCACAGACCGCCGCAGACAATGGAATAACGATTCCGACTGACTGTCTATACCTGATTATTATGTT<br>GATGCCAGAAGCTAAGCAATGGAATAACGATTCCGACTGACTGTCTATACCTGATTATTATGTT |

TABLE 6-continued

SEQUENCE LISTING

| SEQ ID NO: | Sequence |
|---|---|
|  | CCCGAAGAGAATCGCGCGGACCAACTTGTAGTGTTGTTAAGAAGACTTCGCGAGATTGCATATTGCATG |
|  | GGTATTGAAGATGAAGCGCGGTTTCGAACATCTTCGAATAGATCCTGGTGCTCTTTCGAATTTTTCAAACG |
|  | GTAACCCTAAGAGAGAGATTTCTAGGAGGCTGTTAAATAACGATATTATTGCGTTGGCAAACAATATGA |
|  | GTGCCGATGACTCCATATTGGGAAGGGCGTAAGGTGAACTCATAGAAAGGCTTGCGTGGTTAAAGCACA |
|  | GGGCAGAAGGGCTGTATCTTAAAGAACCTCATTCGGTACTCTGGCCGATCATAGGTCACGAATTTCTGG |
|  | CTCAAGGATCGCAGGCTGTTATCTGGTTGCGCTGCAAGTTGAAAATTGCGAAAGACCAAATTTCTGG |
|  | AGTACGTACAGATCTATTTCTGCTAAAAAGACTTGCTGGACGCAGTTCCGAAATGGGCGCCATCCCCGAT |
|  | TTTATTGCGTCAATTTCGCACTTGACAGGTTTTTTAGAAGCTGCAGTTCGAGAATGAGCCAGGACCCTGCTGAAC |
|  | AAGTGAGGGCTCTTACGCTTTTCACTTGAACGACACCTGCAGTCCAGTACCATTTAGAATTTAACAAAG |
|  | CGTTCCCATTTTTCTGACAGCAGAAAAAAAAAAAAGGTGCTAATAGCAACGGTGCTCCATCGG |
|  | AAGAAGAGTACACTGAAACGGAATCAATACAACCTGAGGACCGGAACAGGAAGTAAACGGACA |
|  | AGAAGGGAACGGAGCGTCTAAAATCAAAGAAATTTCAAAGAATACCTAGAATTCTTCGGTGAAGGCT |
|  | CCAGATCTGAATACAGAATTTAACGAAGCTCCACAGTATTCGATATGTTTGTAATAACATGAGGGC |
|  | TATATTTATGCAGTTAGAAAGTCTCCAGAAGCTCCAACACCCGAACAATCTGCAACACCTATTGGCTATAGGGCTTCGAGAG |
|  | TTACAAAATTATACAAACAGCTTTCTTGAATGCACGAACAACAAGTGTCGCCCTCTCTGAGTCA |
|  | GTTTAATCTCTTGGGAGAATTTATACATACGGTGCCAACGAAAAGAAATTTAGATTAAGACATGAA |
|  | GCTTCAGAACCGACAGTGACCAGATTACGGTTCAGCAAGCCTTGGAAATCGCGTCGTCTATTC |
|  | CTTTTTGGCTTCGAATGAGAGAATTGCTCCGCTGGTGTGAAAGAGTGGATTTGGTTGAAATTCACAAAG |
|  | GCTATCAGTTTTTCGTTGGCTATTACTCAAGCTGAGGTCTCTGTTGGTTCATACAATTGCTTGGCAACTC |
|  | AACAGTATCGAGATATTTATCCGTTGCGGGAACTGATACCTTATACGTAGAGTTCTCAAGAACTTAAGGACGGT |
|  | AACGCTACAGTGTTGAGTCAAATGCGTCGGTCTCGGCCATTAGATTGAGTTCTCAAGAACTTAAGGACGGT |
|  | TTTGATGCAACTCCGCTCCGCCCAGACAATCTGCAACACCTATTGGCTATAGGGCTTCGAGAG |
|  | ATTTGCGGCTTGCAAGCGCGCTACTTGTCAGCCAACTGTGATGTCAAGCTTAGTTTTACCGTAGG |
|  | TGCATTCATCGCTTCCGTAATGAAAATGATAGAAAGAGTGACGAACCTTTAGCTGGTGCTTATTTACCG |
|  | CATAGGCCACCACTCTTTCAAAGCCAACAAGTTCAGAACCTTTAAATTAAGCCCTTCTCGTCCACAGTATG |
|  | ACCAGTTCTGTGGTTGACAGTAGTTATTCCAATCACAATATTTGACCGTTTCTATCTCAACC |
|  | GACCAGTTCTGTGGTTGACAGTAGTATTATTCCAGGCGGTGTGCCCTCAGGCGGGTTCAGTTCCGCGTCGAACAACGAGTTGCTTTGAT |
|  | AAAAAATTGGAGTATGAGGGTGTTGCCTCAGGCGGGTTCAGTTCCGCGTCGAACAACGAGTTGCTTTGAT |
|  | ATGAACTTACAAGCAGGCAAGATGAGACTAGAACGTCCGGTGGCCAGGGCCTTTTCATGCCTGTACC |
|  | GTTTCATTTAGGCCATCCGGACGTGGGACCAGTAGATCTGCAACACGTTGTAGAATCGTCGTTGGGTCTGTTC |
|  | CCTCATTCCGGAGGTATAGAATACCGTCGTAGTGATGTCTGTAGTGTCGTGATTAAAATTCTTGAAA |
|  | GAGGCACTATTGCTGTCAATGGTTTCTCTCAGAAAAGGGAGAGCGCCAAGAGAAGCCATCGTGAAA |
|  | AACAAGAGGGGATAAGTGATATAGGGCGAAAGAAGCCTGTCCAGGCAGACGAAGTCGATGCGGCGAA |
|  | CGAATTGCATAGAAAGTACACTGATGTTGCCACAGATTAGGTTGTAGAATCGTCGTTCAATGGCACC |
|  | ACACCTAAAACCAGGACGCACAGCCGCAAACTGTTTACCGCAGAGGCTGTTAGGACAGAAGCTC |
|  | CGAGGAGCGCGAACAAGAGACATGCAAGAATGTTTTAGGGATTTCTACACAGGTGTATTGACAGGAGGGTACTATT |
|  | GGGAGAAACGAAAACCAAGAGACATGCAAGAATGTTTTAGGGATTTCTACACAGGTGTATTGACAGGAGGGTATAGCC |
|  | GAATCCTGTCCCGTCGTAGCAGTCGCTTTATTAGGTCATATTAGAGAAGTTCTTTCCGAGTTAA |
|  | AAAGGAAGAAGTTGTCTTTGAAGAAGTTCTTTCCGAGTTAA |
| SEQ ID NO: 145 | ATGGAAGAAGAATTAATAAGATACGGAGAAAATAATAATCTGCGAGATAATGCGCGATAATGCAACAAAGCCAGTCTCTCGT |
|  | TCAGGCCCCATGAAACCCTTCGTTGTTAAGATAATGACGGATGATTTAAAAAGAGGTTGGAAAAGCGT |
|  | AGAAAAAACCAGAGTGATGCTGCCAAGTTGATCTCAAATAACGCAGCTAATAATCTAAGGATGCTACTT |
|  | GATGATTATACAAAAATGAAAGAACAATCTCGACAGTTTACTGCAGGAATTCAAGGATGACCCGAAATG |
|  | GGACTAATGTGCAAATTGCCACAACCAGCCTCTAAGAAAATTGACCAACATAAATTGAAACCCAAATG |
|  | GAGAAAAGGGAATTTAACAACTGCCGGGTTTGCCTGCTGCGCAATTACTTCGCAGATGTAATGTTGCCGAAC |
|  | AATTAGAGCAGGTTTCGGAAGAAAGGAATTTCGAAGACTTACCAACAATTACTTCGCAGATGTAATGTTGCCGAAC |
|  | ACGAAAACTCATATTGTTAGCTAGCTGTAAGAACGGCCTGAGAAGACTTCGATGAGGCCGTTACTTACTGTT |

TABLE 6-continued

SEQUENCE LISTING

| SEQ ID NO: | Sequence |
|---|---|
|  | GGGGAAGTTTGGTCAAAGAGCTCTCGATTTTATTCTATTCATGTGACAAAGGAGTCCACACATCCCGTC<br>AAGCCCTTGGCACAAATTGCGGTAATAGATACCGTTCCGGTCCAGTTGGGAAGGCCCTTTCTGATGCA<br>TGTATGGGCACAATTGCTAGCTTTCTTAGTAAATACCAGATATCATAATAGAGCATAAAAGTTGTA<br>AAGGGTAACCAAAGAGATTAGAATCGCTCGCTGAGTTGGCGGTGAAGTTGGAATATCCATCT<br>GTCACTCTGCCTCCTCAACCTCATACTAAGGAAGGTAGATGCCTACAATGAAGTTATCGCTAGAGTCC<br>GTATGTGGGTGAATTTAAATTTGTGCAAAATTGAAGTTATCGCGTGATGCAAAACCTCTTCTTAG<br>ACTAAAGGGCTTTCTCCCTGAGCTTCCCTGTAGTGCAAAGACGGAAAATGAGTCGATTGGTGGAATACAAT<br>TAACGAAGTCAAAAAACTGATCGATGCAAAGCGAGATATGGGTCCAGTTTTTTGTCGTGTTACAGC<br>TGAAAAAGGAGTTTAGAAAATCCAAAAAGCCAGCTAAGAACAATTTGGTGATTTGCTACTTTTACCTAGAA<br>AAAGCAGTTTAGAAAATCCAAAAAGCCAGCTAAGAGACAATTTGGTGATTTGCTACTTTTACCTAGAA<br>AAAGTACGCGAGATTGGGGAAGTCTTGACGAAGTTGGGAGAGATAGATAAAAAAATAGCA<br>GGATTGACGTCACACATTGAAAGAAGAGGCGAGAATCAGAGATGCTCAGTCCAAAGCTGTCCT<br>CACCGACTCGTTGAGAGCCAAAGCTCCTTGTTCTGAACGCTAAAAGAAATGATGAGAAGGAATT<br>TTATGCCTGCGAAATCCAGCTACAAAAATGGTACGGAGCTTGAGCAGGTAACCCCTTTGCCGTGAAGC<br>AGAGAACCGTGTCGTGTAGATATCTCAATCGGTAGCGATGGACACTCCATTCAGTATCGCAAC<br>TTGTTGGCCTGGAATATTTGGAAAACGGTAAGAGGGAATTCTATTACTTATGAATTATGGCAAGAA<br>GGTAGAATCAGGTTTACTGACGAACAGACATTAAAAGAGTGGTAAGTGCAAGGCCTTTTGTACGGT<br>GCTGCAAGGCCAAAGTAATAGACTTAACATTTGACCCCGACGAACAACTGATAATACTGCCTTA<br>GCTTTTGGTACTCGACAGGGCGAGAGTTCATTGGGAATGATCTTTTGTCACTCGAGACTGGTTTGATAA<br>AACTTGCAAATGGAAGAGTCATCGAGAAGACAATTTACACACAAAAAGATAGGTCGCGATGAGCCTGCA<br>CTATTTGTGCCTTGACCTTTGAGAGAAGGGAAGTTGTCGACCCATCCAATATTAAACCAGTCAACCTAA<br>TCGGTGTAGATAGAGGTGAAAACATCCCAGCTGTTATCGCTGTATCCGTGTTGCCCTTGCC<br>AGAATTTAAAGATTCGCTGTGGACCAACAGAATATATTACGTATTGGGAAGCTATAAAGAGAAACA<br>ACGTGCTATTCAGGCTGCAAAAGAAGTTGAACAGAGAAGCTGGAGGTTACAGTAGAAATTCCCA<br>GTAAAGTGCTATTAGAACTTAGCAGATGACATGGTTAGAAATCTATCCGCCGTTTTGGTAGGCAAGGCAAGGACTTTAT<br>CTCACGATGCAGTCTTAGTCTTTGAAAATCCAAATTGGTTAACCGCAAGCTGCATATGAAGTCTTACTTC<br>GACAGAGAGACAATATACAAAAATGGAAATTGTCGTCAATATACTTCAAAACTTGTCAAATTGTGTTTACTATT<br>GAAAACTACCTCAGCAAACGCTGCTCAATATCTTGAGATTGAAGAAGACCAGCGATGGTTTGGCCAACAACATT<br>ACCACGGCCAGACTACGACCGGATGTTGTGAGATTGAAGAAGACCAGCCATGGTTATAAACGCCAAACGGTTG<br>GAATAATAAGGAATTAAAAGCGAGTTGCAGCCGAGTTGGAAGTAAGTGAAGAGCGTAACAATGATATCTCAAAGTGG<br>AGAAAGAGTTGTCAGCCAGTGGAAGCCCTCTTTTTACTAAAGAAGAGATTCTCACATAGACCTGTGCAAGAA<br>CAATTCGTTTGTTTAGATTGTGGCCATGAGGTTCATGCAGACGAACAGGCTGCGTTAAATATTGCGAGAA<br>GCTGGCTATTTCTAAATTCTAATTCAACAGAGTTCAAGACGTTCAAGAACCACCTTTCGTAGG<br>CGCGTGCAAGCCTTCTATAAAGGAGATTAAAAGAGGTTTGGAAACCAAATGCA |
| SEQ ID NO: 146 | ATGAAAAAGAATTAACAAAATTAGAAGGAGGCTGTCAAAGATTCTAATACCAAGAAAGCTGGTAAGAC<br>TGGTCCGATGAAAACCCTATTAGTCAGAGTTGATGACCCAGATTTGAGAGAAGATTGAGAACCTCAG<br>GAAAAGCCCGAAAATGCAAAACATCCCACAACCATTAGTAACAACCATCAAGAGCTAATTTAAACAAGTTATTAAC<br>TGACTAACTGAAATGAAAGACATATTCCATGTTACTCGGAAGACATCAAGAAGATCTCTGTTGG<br>GTTGATGTCTAGAGTTGCTCAACCGGCCCAACCCAAAAGAATAATATAGATCAAAGGAAACTTATTCCTGTGAAGGA<br>CGGCAATGAACAAGTAACCAGCTCCGGTTCGCTTGCTGCCAACCCTGTATGATAATACAAA<br>CTGGAACAAGTAAAATGACTAAAGGTAAGCCACATACAATCTACCTTTGGTAGGTGTAATGTAGCCGAGCAT<br>GAAAGATTGATCTTGTTAAGTCCCCATAAAACCAGAAGCTAATGATGAGTTAGTAACTTATAGTTTAGGTA<br>AGTTCGGACACAACAAATCGGTGTAATAGTTGTCGCTCAGGTCCAGTAGGCAAAGCAATCACCGTCAAAC<br>CACTCGGAACAAATGCTGTAGTTTTTGACGAAATACCCAAGATATATTCTCAGGTCCAGTATACTCAGACGCTTGCA<br>TGGTGCCCGTGGCTAGTTTTGAGAAATACCAAGATATATTATCAGGAACATCAAAAGTAATTAAAA<br>AGAATGAAAAGACTCGCTAACTTAAAAGATATTGAAGTTACAATAATGTAGCCCAAATAGTTA<br>CCTTGCCACCTCAGCCACATACACAAGGAGGAATTGAAGCTTACATAATGTAGCCCAAATAGTTA |

TABLE 6-continued

SEQUENCE LISTING

| SEQ ID NO: | Sequence |
|---|---|
| | TTTGGGTGAACCTTAACCTATGGCAAAATTAAAAATTGTAGAGACGAAGCCAAACCCCTGCAGAGGC
TGAAGGGTTTTCCCTCCCTTCCCCTTAGTAGAGGACAAGCTAATGAAGTTGGACTGGTGGATATGGTGT
GCAATGTTAAAAAATTGATTAATGAAGAAAGAGGATGTAAAGTGTTTTGGCAGAATTGCTGGCT
ACAAGAGACAGGAAGCTTTACTGCCTTATTTATCTTCGAGGAAGATAGGAAAAGTAAAAAATTTG
CTAGATATCAATTCGGAGACCTACTTCTGCATTTAGAAAAAAACATGGCAAGCATATTAAATTAGAGGAA
ATGATGAAGCCTGGGAAAGAATTGATAAGAAGGTAAGAACATGGAAGGTCTCTCCAAACATATTAAATTAGAGGAA
GAACCTAGGTCCGAAGACGTCAATCAAGGCAGCATTAACTGATTGGTTGAGCACAAAGCCTCTTTC
GTTATTGAAGGATTAAAAGAAGCCGACAAAGATGAATTTTGTAGATGTGAGTTAAAGTTGCAAAAGTGG
TATGGAGACCCTCCGTGGTAAACCTTTTGCTATTGAGGCTGAAAATTCTATACTCGATATCTCTGATTTTC
AAAACAATATAACTGCGCATTTATATGGCAGAAAGATGGTGTTAAAGCTAAATCTATACTTAATTAT
CAATTACTTTAAAGGTGTAAATTGCGTTTGAAGCAAATAAAGCGTTTTGAGGCAAACCGTTTT
TACACTGTTATCAATAAAAAATCGGGAAATCGTACCAATGAAGTTAATTTCAATTTCGATGATCCTA
ATCTTATTATTTTACCCTCTTGCTTTCGGCAAAGGCAAGTAGGGAGTTTATTTGGAATGATTTATTGTCG
CTGGAAACGGGTCTTCTCAAACTCCAACGCTAGGGTGATAGAAAAAACATTATACAACAGGAGAAC
TCGGCAGAGATGAGCCAGCTCTTTTTGTGCCTCTGACATTGCAGACATGGTTTAGATTCATCTAAC
ATCAAACCAATGAATTTAATAGGTATTGACAGGACTCGTTGGTGAAAATATACCTGCAGTTATTGCTTTAACTGATC
CTGAGGGATGTCCTTAGCAGATTCAAGGACATATACAAGCTGTTGGGTAACCTACTCACAATCTTAAGGATTGGAGA
AAGTTACAAGGAGAACAAAGACAATACAAGCTCTAAAGAAGTAGAACAAGGAGGCGGGTGA
TATAGTCGGAAATATGCCAGCAGCCAAGCCAAGAATTAGCTGACGACGCATGGTTAGGAATACAGCTAGAGAC
CTTTTATACTATGCCACCCTTCATGGCAGAGACAATATACTAGAATGGAAGATTGGTTGACTGCCAAATTGG
AAGTAAGCGCACTTCTACCTAGTTAAGACGTACTTATCTAAAACACTTAGCGCAGTATACTTCCAAGACATGCA
GTAATTGTGTTTCACAATCACTTCTGCCGATTACGAATCGCGTCTTGGAAAACTAAAAAAAAACAGCGA
CAGGTTGGATGACTACTATTAATGAAAGAACCTGTCAGTCGAACCTCGATCCACTTGAAGAATCTGTTAATA
ATAAACGGCAAACGTTGTAAAGAACCTGTAGATCCGGTAAGATCCAGTCGAACTTTAAGCC
ATGATATTAGTTCGTGACAAAAGTTTGTATGTTTAAGATCTCAGGAATACAAGTACCAGACTAACAAGAC
CTCTTAATATTGCCTAGATACATGGTTATTTTAAGATCTTGAGACTTGCTGTTTGAGACCCATGCAGACGAGCCG
AACAGGCAACACCAGATAAGCGAGCATTCGTTGAGACTTGCGCAATCTTTTTATAGAAAGAAATTGAAGA
AGTCTGGAAACCA |
| SEQ ID NO: 147 | ATGGGAAAAATGTATTATCTAGGCTGGACATAGGGACCAATTCAGTAGGCTACGCTGTCACTGACCCC
TCCTACCATTTGCTGAAGTTCAAGGGGGGAACCATGTGGGGAGCCACGTTGTGCGGCCGGCAACCAG
AGCCCAGAGCGGAGAAGCTTCCGCGACCTCCAGGAGAAGGTCGATCGCAGGCAGCCAGCGTGTGAAGCT
GGTCCAAGAGAGATATTTGCCCGAGATCGATTCCCATCGATCGCGCTTCTTTATTAGGCTCCACGAGTCC
GCTCTCGGACGCGACGGTGGCCGACGAACTGTAAACATATTTCTTTAATGACCAACATACACTGACA
AGGAGTACTATTCAGATTACCAACAATTCACCATTTGATCGTGGACCTTATGGAAAGTTCGGAGAAGC
ATGATCCTCGACTTGTCTATTTGGCCGTGGCGTGGCCTCGTGGCACATAGGGGCCACTTCTTGAACGAGGT
GGACAAGGATAACATCGGGAGATGTGTTATCTTTCGACGTCTTACCAGGCGACCTAAGTGCCTAATAGCG
ACAATGGCGGTCAGCCGTGGGTCGTGCGAATCCAAGGCCTACCGTATCGTCAAGAAATAGCG
TGAACGACAAGTACAAGGCCTCTTAAGTCTTTAGTTTTGATTTTGAAGCCAGAAGCCCAGAGCAACACTTTGATG
CAATATCTCGGAGGACGGGGCTCGAGCTTCACCCTTAACGACAAGAGGATGCCATTGAAGAGATCCTGGG
ACACTCACCCCAAATGCAAATGGCGAGTGCAGATGCCCATATTAGGCGCCCTCTTGATTGGGCCATAATGAAA
CATGCGCTTAAGGACGCCGGCGGCCACGATATTTGTAAAAAAACATATCTGGCCAAGGAGTACCAAGTCAAATTGTACGAGCAGCACCATGAT
CTGACCCCAGCTAAAATATTTGTAAAAAACATATCTGGCCAAGGAGTACCAAGTCAAATTGTACGAGCAGCACCATGAT
GATAGTGAGACCACCAAAACTACGTCGCGTACTCATACCACGTGAAAGAAGTTAAGGCACGCTGCCT
AAGAACAAGGCCAACAAAGGCCAAAAACTTCTCGGAAGTACGTTCCGAAAGTAAAATATAGAGTGCAG
CGAGGCCGACAAAGTGGATTTTGACGAGATGATTCAACCGCTGACCGACATTCTTTATGCCTAAACA |

TABLE 6-continued

SEQUENCE LISTING

| SEQ ID NO: | Sequence |
|---|---|
| | GGTGAGTGGAGAGAATCGCGTGATTCCATATCAGCTCTATTACTATGAACTCAAGACTATTCTGAATAA |
| | GGCCCGCTAGCTATTTACCCCTTCCTTACGACGTGATTCGGGAGGATGCCATTTCTAACCAGGATAAACTCTTG |
| | AGTATAATGACATTTCGAATTCCCTATTTCGTGGGTCCGTTCGTTAAGGATAAACAGTGAGCACGCTTGGC |
| | TGGAGCGGAAGGCTGGCAAAATTTATCCATGGAATTTCAACGACAAGGTGGATCTGACAAATCCGAAG |
| | AAGCCTTATCCGGAGGATGACCAATACTTGCACATACTATCCTGGGAGGATGTCCTTCCACTGGACTC |
| | TCTGATCTACGAAAAGTTCATGATTTTGAATGAAATTAACAACATAAGGATCGATGGGTATCCTATTTCC |
| | GTCGACGTGAAGCAGCAGTGTTCGGGCTGTTTGAAGAAGACAGCGGGTGACCGTGAAGGATATTCAG |
| | AATCTTTCTTATCCTGGGAGCCCTGATAAACACGGAAAACTGACCGGGATAGATACTACGATTCAT |
| | TCTAATTACAACACGTATCACCATTTTAAGTCACTGATGGAGAGGGGCGTCCTAACAAGAGATGACGTG |
| | GAGAGAATAGTGGAACGAATGACATATTCTGATGACACCAAGAGAGTGCGGCTTTGGCTGAATAACAA |
| | CTACGGCACTCTGACGCGCGATGATGTAAAGACATATTTCCCGACTCCGTAAGACATGACTTCGGCGGCT |
| | GTCTAAGATGTTTCTAACAGGCCTCAAGGGTGTGCATAAGGAGCGCGCTAGCATCCTGA |
| | TTTTATGTGAACACCAATGATAACCTGATGCAGCTCCTGTCAGAATGCTACACATTTCGGACGAAATC |
| | ACCAAGCTGCAGGAGGCTTACTATGCCAACTAAGCTTGAATGATTTCTGGATTCTATGTACA |
| | TCAGCAACGCGTAAAACGACCAAATTATAGGACACATTAGGAACATTAGGAAGCATGCG |
| | GAACAGCTCCAAGCGAATCTTTATCGAGATGGCCCGACGAGTAAGAGTAAGAAAGGTCAGTG |
| | ACTAGGCGGGAGCAGATCAAGAACCTTTACCGCTCTATCCGAAAGACTTCCAGCAAGAGGTTGATTTC |
| | CTTGAGAAGATCTTAGAGAACAAGTCAGATGGAACAGCTCCAATCCGATGCTCGTATCTGTACTTCGCTC |
| | AGCTGGACGAGATATGTACACTGGCGACCCCATTAAACTAGAACATATCAAGGACCAATCGTTTTATA |
| | ATATCGACCACATCTACCCTCAGTCCATGGTGAAAGACGATAGTCTGGACAATAAGGTGCTCGTCAAA |
| | GTGAGATTAACGAGGAAAGTCGAGCAGATATCCTTTGACGCTGCGATCCGCAACAATGAAGCCCC |
| | TGTGGGATGCTTACTACAATCATGGAAGTCAGCCTGAAGAACTATCAGAGACTGACCGGAGTACCC |
| | CTTTCACAGACCGATGAGAAGTGATTTTATCAATAGAACAACTGGTGAAACCATGTTCCACGAAAG |
| | CTCTGGCCATTCTTCTGAAGAGAAAGTTTCCAGACACAGAGATCGTCTATTCAAAGGCCGGCCTCAGTTC |
| | CGACTTTAGACATGAGTTCGGACTCGTTAAATCACGAAATATAAACGATCTCCACCATGCAAAGGACGC |
| | ATTCCTCGCCATTGTGACTGGAAATCTATCAGAAGATTTAATGAGGCGGTGTTCATGGTTAACCAG |
| | CCATACTCAGTGAGACCAAGAACCTTTTCACTCACTCACATCAAAAATCGCAATGCAACTTCGTGGCTTGGAATG |
| | GTGAGGAGGATCTTGAAGAATTGTGAAGATGTTAAAACGACAATAAGAATAACCATCCACTTTACTAGAT |
| | TCAGCTTTGACCGGAAAGAGGGGCTATTCGATATTCAACCGTTAAAGGCTTCAACAGTCTCGTTCCACG |
| | AAAGGCCGACTGACGTAGTGAAATACCGGCGTATGATAAAGGAGCACCCAGCTTACTACCTCCTTGT |
| | GCGATTTACCGCTCGAGGATAGAAGAAGAACCCAACACAGATCACAAGTGATGATGATTCCCGTGGAGGGACTGTACAA |
| | AGCTCGAATTGACCATGATAAAGAGTTTCTCACAGATTACGCAAAACCACCATCTCTGAGATTCTCCAG |
| | AAAGACAAACAAAAAGTTATAAACATATAAAATGTTTCCAATGGAAGTCTAGTAAGGCAAGTCTGTCCTGCCATG |
| | ATCTCCATTGATGGCTTTTATTTGTCCCACAGAAGATTGAATGCTAGTTAAAGGCAAGGTATATGGGAGAGTTTTGCTCGA |
| | CCATGGTACCCCTAATCGTCCACAGAAGATTGAATGCTAGTTCACAAGATATTCAGAAGACAATCTGA |
| | AATTTAAAGAGAATATAAGCTGCTATTGTGAAAAATTCACAAGATAACCGTTGAAGACAATCTGA |
| | ATCGTACGACGCTCTTTCTGCAGAGCTGCAGCATTTCACAAGACCTAGTCCTGAGGAACCAGGTGCAAACAGTCCTAAA |
| | TGTACTGACCAACGGGCGATCAACTTTCACAAGACCTAGTCCTGAGGAACCAGGTGCAAACACTCCTAAA |
| | CATTCTTTTCATTTTAAGACTGCAGCTCGACTCGACAGGGCGACTTGAAGAGTCCGACATTCGGCTTGTA |
| | GCAGCTAGGATCATGATCTCAGGGTGTTCGTTAGTAAGTGCAGAACCTCTGCAGATACCTGTAA |
| | GAGCGAAAGCGCCAGTGGGTGTTGTTCGTTAGTAAGTGCAGAACCTCTGCAGATACCTGTAA |
| SEQ ID NO: 148 | ATGTCTTCTTTGACGAAGTTTACAAACAAATACTCTAAGCAGCTTACAATTAAGAACGAACTGATTCCG |
| | TAGGAAAGACTCTGAAAACATCAAGAAGAATGGGCTGATAGACCGGCTGATAGACCGGCAACAACTGAATGAGAAC |
| | TATCAGAAGGCCAATTGCGCGGAACTGCCGACGCTCTGAACAAGAAGATGAGGACAATATCGAAAATT |
| | CAGATCGGCAAATTGCGCGGAACTGCCGACGCTCTGAACAAGAAGATGAGGACAATATCGAAAATT |
| | ACAAGACAAAATCAGGGGCATTATTGTCAGTAAGTTCGAGACATTCGATCTGTTCTTCGTACTCCATT |
| | AAGAAGGACGAAGAAATCATCGATGATGACGACGTTGAGGAAGAACGTTGAGACGGACTTGGGTAAAA |
| | GACCCTCATCCTTCGAGTATATTTTTAAAAAAATCTGTTTAAATTAGTGCTCCCAGTGTTATTTTAAGACA |

TABLE 6-continued

SEQUENCE LISTING

| SEQ ID NO: | Sequence |
|---|---|
| | ACTAACCAGGACAAGCTTAAGATTATCTCCTCTTTTGACAACTTTAGCACCTATTTTAGAGGCTTCTTTGA |
| | AAATCGCAAGAATATTTCACTAAGAAGCCCATAAGCACCTCTATTGCCTACACAGAATCCTACATGATAA |
| | CTTCCCAAAATTTTGGATAACATTAGATGTTTTAATGTATGGCAGACCGAATGTCCTCAGTTAATTGTG |
| | AAGGCGGATAACTACCTCAAATCCAAGAATGTGATCGCCAAAGATAAGTCTCTTGCTAACTACTTTACG |
| | GTCGGAGCCTACGATTACTTCTTATCTCAAAACGTATTGACTTTTACAATAACATTATCGGGGATTGC |
| | CTGCCTTCGCCGGCCATGAGAAAATTCAGGGCTTAAACGAGTTCATAAATGCGGTCTTGTTCAAACGATCCTCA |
| | CAGAGCTGAAATCAAAGCTTAAGAATCGACACGCATTTAAAATGCCGGTCTTGTTCAAACGATCCTCA |
| | GCGATAGAGAGAAAAGCTTCGTTATTGATGAATTCGAGAGCGACCGCACCAGGTGATTGATGCCGTGAAGA |
| | ACTTCTATGCGAACCAGTGTAAAGACAACTATGTTATTTTCAACCTATTAAACTTGATTAAGAATATCGC |
| | GTTTTTAAGTGACGATGAACTCGACGTATCTTTATAGAGGCAAGTACCTGTCCTCTGTCAGCCAAAAA |
| | CTCTACTCAGATTGTCTCAAGCTAAGAAATGACATCGAGGACAGTGCTAACAGCAAACAGGGCAATAA |
| | AGAGCTGGCAAAGAAAATCAAGACTTACTAATAAAGGGATGTGGAGAAGGCGATATCTAAATATGAGTTCT |
| | CCCTCTCCGAACTGAACTCCATCGTCCACGATATACCAAGTTTAGTGATCTGTGTCGTGTACACTGCA |
| | CAAAGTGGCCAGTGAAAAACTCGTCAAGTGAACGAAGGCGATTGGCCCAAACACCTGAAAAATAATG |
| | AGGAGAAACAGAGATCAAAGAACATTTGGATGTTGCTCGAAATATATAACACACCTGTTGATCTTCA |
| | ACTGTAAAAGCTTCAACAAGACGGGAACTTTATGTAGACTACCATCGATGTATAAATGAACTGAGCA |
| | GCGTCGTTTACCTGTACAACAAGACTCGCAATTATTGTACGAAAAGACCATATAACACCGATAAGTTCA |
| | AGCTTAATTTCAACAGTCCCCAGCTGGGAGAAGGGTTCAGCAAATCAAAAGAAAAACGATTGCCTGACAT |
| | TACTCTTTAAAAGGATGATGATAATTATTATGTTGGGATTATTAGGAAAGGCGCTAAGATCAACTTTGACGA |
| | CACACAGGCCATAGCTGACACACTGATAACTGCATCTTTAAAATGAATTACTTTCTGTTGAAGGACGCC |
| | AAAAAATTCATTCCAAATGCTCTATTCAGCTCAAGGAGGTTAAGGCCCATTTCAAGAAGTCGTGAAGAT |
| | GACTACATCCTCTGACAAGGAGAAAATTCGCTAGTTCTCTGGTTATCAAAAAAGTACCTTCTTGCTGG |
| | CTACGCTCACGTGAAAGGCCAAGAAGAGACATTAAGAAGTTCCAAAAGGAATACAGCAAAGAGAAT |
| | CCAACCGAGTACAGAGAATTCTGAACGAATGGATCGCATTCGTAAAGAATTTCTAAAGACGTACAAG |
| | GCCGCTACCATTTTCGATATTACCACCTGTGATATTAAAAAGCCGAGGAGTACGCCGAATCGTCGAATTCTATA |
| | AAGACGTGGATAACCTGTCGATTGGAATTCGCCAGCCAATTTTCTGAAAATCTCATTGAAAACCTCAT |
| | CGACAATGGGACCTCTACTTATTTAGAATTAACAATAAGACATTTTCTTCGAAATCTACCGGAACTAAA |
| | AATCTGCACACACCTGTATCTGCAAGCAATCTTCGATGAACGTAATCTCAACAACCCTACATAATGCTGA |
| | ACGGCGGTGCTGAACGTCTTCTACCCGTAAAGAGTATTGAACAGAAGAATCGAATCACACACAAAGCG |
| | GGCAGTATTCTCGTCAATAAGGTGTGCAAAGACGGGACCAGCCTGACGATAAGATCAGGAATGAAAT |
| | ATATCAGTATGAGAACAAGTTTATCGACACCCTTGTCGATGAGGCCAAAGAAGGTCGTACTACTAACGTTAT |
| | CAAGAAGGAAGCTACCCATGACATAACCAAGGATAAGCCGTTCACTTCTGACAAGTTCTTCTTCCACTG |
| | TCCTCTGACCATTAACTACGAAGGAGGAGACACTAAACATTCAATAATGAAGTACTTAGCTTTTTGCG |
| | GGGTAATCCCGATATTAACATAATTGGTATCGACCGGGAGAACGGAACCTGATATACGTGACAGTAAT |
| | TAATCAGAAAGGAGAAATCTGGATTCCGTATCCTTCAATACCGTCAATAAGTAGTAAAATCGA |
| | GCAGACGGTCGACTACGAGAAAGTTAGCAGTGCAGAGGAAGAGAATCGAGGCCAAACGTTCCT |
| | GGGATAGTATCAGCAAGATTGCTACTCTGAAAGAAGGATATCTGTCCGCTATCGTCCATGAGATCTGTTT |
| | GTTGATGATCAAGCACAATGCTATATGTGTTCTCGAGAACGAACGCTTCAAGCGAATTAGAGG |
| | GGGCCTGTCGGAAAAAGCGTTTACCAGAAGTTTTAAACGATGCTAATCAATAAGTTAAATTACTTTGT |
| | AAGTAAAAGAAGAGAGCGATTGGAATAAGCCACCATCAGAGACTTTTAAACGGCTCAACTGAGCGACCAGT |
| | TTGAGTCATTCGAAAAACTGGGTATTCAGATGTGGTTTCATATTCGTGCCGCTTACACTTCAAA |
| | GATCGATCCTACAACTGGTTTTGCGAATGTCCTGAAATCTGTCTAAGGTGAGGAATGTGACGCAATCAA |
| | GTCTTTCTCAGCAACTTCACAAGAAGGATTCTCTTCTTTCGTAAAGTTTCTAAGTCCAAATGGAACGTCTACA |
| | CTGGATAGCCTGCCAAGAAAGATTCATCTTGTTGGATCATCAAGCAGTTTCTAAGTCCAAATGGAACGTCTACA |
| | CGTTCGGAGAGAGAATCATTAAACAAAGAACAACCAGGGGTATCGGAAGACAAAAGGATCAATCTG |
| | ACTTTCGAAATGAAGAAACTATTGAATGAGTAACACATTCTGAAGGACTCATTCGATTTGGAGAACAATCTGATCCCC |
| | AATCTACCAGCCGCTTAACCCTCAAATAAACCCTGCCTCAGGACTGTGACGACTGACTCACCTGTGAAAAACGCCAAGGGG |
| | AGCTACGGAATAGTGTCCGGCCACCCATAACACAACCCTGCCTCAGGACTGTGACGACTGACTCACCTGTGAAAAACGCCAAGGGG |
| | GAGTTCTTTGTCGTCCGGACGTGTCACGGACTGACGACTGACTGACTCACCTGTGAAAAACGCCAAGGGGCCTACCAC |

TABLE 6-continued

SEQUENCE LISTING

| SEQ ID NO: | Sequence |
|---|---|
| | ATCGCGCTAAAGGGGTTAATGATTCTGAACGTAATAATCTGGTGCGCGAAGAAAAAGACACAAAGAA |
| | AATTATGGCCATCAGCAACGTTGACTGGTTTGAGTACGTGCAGAAGCGTCGAGGAGTTTTGTAA |
| SEQ ID NO: 149 | ATGAACAACTATGACGAGTTCACTAAACTTTACCCCATTCAGAAAACCATCAGATTTGAACTGAAGCCT |
| | CAGGGTCGTACCATGGAACACTTGGAAACTTTCAACTTTTCGAGGAGGACAGGATAGAGCTGAGAAA |
| | TACAAGATCTTGAAAGAGGCCATCGACGAGTTCATCAAAAAATTCATCGATGAGCATCTCACCAACATG |
| | TCGCTGGATTGGAACAGTCTCAAGCAGAGTTTCCAGAAGACTATATAAATCTCGGGAGAGAAAGATAAA |
| | AAGTGTTTTTGAGCGAGCAAAAGCGAATGCGACAGGAGAGTAGTCTCTGAATTTAAGAAAGATGATCGG |
| | TTTAAAGACCTATTTTCCAAAAAGCTTTTTTCAGAGCTCTGAAGGAAGAGATCTATAAAAAGCAAT |
| | CACCAAGAAATTGATGCCCTGAAATCATTCGACAAATTCAGTGGGTATTTCATAGGACTGCATGAAAC |
| | CGGAAGAAATATGTATAGTGATGAGCAACGATCACAGCCATAAGCAATCGAATCGTTAACGAGAATTTC |
| | CCGAAGTTCCTGGATAACCTGCAGAAGTATCAAGAGGCTAGGAAAAAGTACCCTGAGTGGATCATCAAG |
| | GCTGAATCAGCTCTGGTGGCTCACAATATCAAGATGGAATGGAAGTCTTTAGTCTTGAGTACTTTAATAAG |
| | TCCTTAACCAGGAGGGCATCCAGCCTATAACCTGGCTCTCCGGTGGCTACGTCACAAAAAGCGGAGAAA |
| | AGATGAGGGCTGTCAACGATGCACTGAAATTGGCCTCATCGTCGGAGAAGTCATCTAAGGACGCATAC |
| | ACATGACACACCACTGTTAAACAAATCCTAGCGCGAAAAGGAATCATTTTCGCTCAGATAGAGACGACAAAGATGGCAA |
| | CGAGGACTCACAACTGCTCCTAGTATAGGGGGTTTTCGCTGGAGTTGATTTCATCTTACGCGAGGAGCGATACGGAGCGCATTATATTCGC |
| | CATTTTTGACAGAGCCTTGAGTTGATTTCATCTTACGCGATGATGAAGAGTCCATCCATATTATTAAAACCTTCTGGACTCAGTGCA |
| | CAGCGGGATATCAACAGGGTTTCCAATGTGATCTTTGGCGACGTCTTTGGCGAACGCTGCGGGCGGCCTGATGCGG |
| | GAGTTTGATGAAGTTCATTCGAAACTTTTTGCTATAGTGCCTCTCTATAATAAAGTTCGCAATTACCTGA |
| | GAATCAAAGCCGACTCGATCAATGACATCAACCTGGAAGCATTGAAGAACATGCAAGAAGGTCGATAAATGGTT |
| | GGATAGCAAAGAGTTCGCCCTGAGTCGCTTGAGAATGGACACCGCGAGGAGAAAAATTGATGCAGCAAGGAGATGAAGT |
| | CAACAGTATATCTCAAAATGAGGACCGCGAGAGAAAATTGATGCAGCAAGGAGATGAAGT |
| | TTATATCGAAGATCTCAGCCGATGAAGAGTCCATCCATATTATTAAAACCTTCTGGACTCAGTGCA |
| | GCAATTCCTCCACTTTTTTACCTCTTCAAGGCCAGGCAGATAATCGTTAGACGGGGCTTTTTATGCC |
| | GAGTTTGATGAAGTTCATTCGAAACTTTTTGCTATAGTGCCTCTCTATAATAAAGTTCGCAATTACCTGA |
| | CAAAGAATAACTTAAACAAAGAAAAATCAAGCTCAACTCAACAAACCCAACACTGGCAACGATGG |
| | GATCAGAACAAGGTATATGATTACCGCCTCATTGATTTTCCTCCGGACGAATTACTATCTGGGATCA |
| | TCAACCCTAAGCGCAAAAGAACATTAAGTTCGAACAGGGATCTGGCAATGGTCCCTTCCACTAAGGGAA |
| | TGGTATACAAACAGATTCCTGGCCCCAACAGAATTATCGAGGCTATGAGGCAGCAAGCATATATTAGGGGTGAC |
| | AGAAGGAGTACAAGCCGTCTAAAGAATTATCGAGGCTATGAGGCAGCAAGCATATATTAGGGGTGAC |
| | AAGTTTGACCTAGACTTTGTCATAAGCTTCATAAGCTTTTTCAAGGAGTCCATAGAGAAGCACACAAAGATT |
| | GGTCAAAGTTTAATTTCTATTTTCTCCAACGAGTCTTCTACGGGATATCTCGAGTTCTATCTGGATGTT |
| | GAAAAGCCAGGGGTACAGAATGCACTTCGAAATATCTCAGCAGAACTATCGATGAGTACGTAGAGAA |
| | AGGAGATCTGTTTCTTTTCCAAATCTACAATAAGGATTTTGTGAAGGCCCGCACTGGGAAGAAGGACAT |
| | GCACACTATTTACTGGAACCGCTGCATTTTCCCTGAAAATCTGCAGGACCGTAGTGAGATTAAATGGT |
| | GAGGCGAACTGTTTTACCGCGAACTATAAATCAGAAATATGTGCACCGGGAAGGCGAGATTCTT |
| | GTTAACCGACACATATAATGGCAGGAACACTGTCCCGTGAGAGAATTCATAAGAACTGAGTACTTCAAGCCCA |
| | AACCGTCGAACCAAGGATCTGGGCGAGGCCAAGAATACCTTAACGACAAGAATACTACTTCCATGTCCATGTCCACCTTGAAC |
| | TTCAAAGCTAACGTGTAAGAAGAATTACCAAATGGTGATTGAAAAAATTCTGTCCGATGAGAAGCC |
| | CATATCATCGGCATTGATCGCGCCGAATCACTGAATGTCATCGACGATTCGACGATTCATCATTTCTATCATTGATCGTCGGGAAAGA |
| | TTATCGACCAACAATCACTGAATGTCATCGACGATTCGACGATTCATCATTGAAGTAAAGATTTGAAAGAAGGTTACC |
| | TCTCCAAAGCAGTGCGACGAAATTACCAAATGCAATCCAGTACCAATGCTATTGTGGTAATGAGGAGT |
| | TAAATTACGATTTAAGCGCGGAGAGTTCAAGGTTCAAGGACGCACCTGAAGCTAGGAAGCAGACTGGCATTCTGTTTAACGTCTTTTACGT |
| | TGATTGATAAGATGAACTACCTGGTTCAAGGACGCACCTGAAGCTAGGAAGCAGACTGGCATTCTGTTTAACGTCTTTTACGT |
| | CATATCAGCTGACATCCAAATCCAAAATACCACCAGAGAGTTGCCAAGCTAGGAAGCAGACTGGCATTCTGTTTAACGTCTTTTACGT |
| | CCCTGCAGACTATACATCCAAATCCACCAGAGAGTTGCCAAGCTAGGAAGCAGACTGGCATTCTGTTTAACACCTCCTCCAAA |
| | ACCAACGCACAAGAACGCAAAGAATTTTGCAAAGTTTGAGTCGTATGGAGTCGATGTTTAACACCTCCTCCAAA |

TABLE 6-continued

SEQUENCE LISTING

| SEQ ID NO: | Sequence |
|---|---|
|  | GGGATCTCTTTGCTTTCGCATTCGACTACAGGAAATTCGGACGAGTAAGACAGAGCAGACCAAGAACGTCTGG |
|  | ACCGCGTACACTAATGGGGAACGCATGCCTGCTACATCAAAGAGAAAAAGAGGAATGAACTTTTTGACCCT |
|  | TCAAAGGAAATCAAGGAAGCTCTCACCTCAAGCCGTATCACATATGGCTCTCCATTGCAGCAATTCAAA |
|  | GATATCCTCAGATCGAACAATAATGGACTTATCTATATCGCACGCTGAACTCCAATTAAGAACTCAAAGGCGAATTCTTCC |
|  | TGAGAGTGTACGATGGAAGGAGGATTACATTATATCGCCAATTAAGAACTCCAAAGGCGAATTCTTCC |
|  | GCACCGATCCTAAGCGAAGAGAACTCCCCAATGCACGCTGATGCGAACGCGCCTATAATATAGCCCTGC |
|  | GGGGTGAATTAACATGCGCTATTGCCGAGAAGTTCGACCCGATTCAGACCCCGATTCAGAAAAATGCTAAGCTTG |
|  | AGCTGAAACACAAAGATTGGTTCGAATTCATGCAGACAAGAGGCGACTAA |
| SEQ ID NO: 150 | ATGACTAAGACCTTCGATTCCGAGTTCTTCAACCTTTATTCCCTGCAGAAAACTGTAAGGTTTGAGCTGA |
|  | AGCCGGTGGGCGAGCAGACCAAGCAAAAGATCCCGAGGATTCTCAAGAATGAGGGGTCTCAAACGGGTAGTTAGTG |
|  | AGGATGAGAGGAGGAGCAGTCGAATTACTTCCCTGAGCAAGTATCCAAAGACGCGCTGGAACAGGCCTTTCATCTTT |
|  | ATAGGAGTCGTTGAATTACTTCCCTGAGCAAGTATCCAAAGACGCGCTGGAACAGGCCTTTCATCTTT |
|  | ACCAGAAACTGAAGGCCAGCGAAGGTTGAGGAGCGGAGAAAAGGCCTTGAAAGAGTGGAAGCCCTGCA |
|  | GAAAAAGCTCAGAGAAAAGGTTCAATGCTCAAGGCAACAAAGCCAGGTTCAGTAGGATCG |
|  | ATAAGAAAGAACTGATCAAAGAAGACTTCACAACTTCACAACTTCTCCGGTTGATCCACAGAATGGGCCAAGTCTCTGA |
|  | CCACCGTAGAGATGATCATGCAACCGCCATCTCCTTCCGGTTGATCCACAGAATGTAAAACATCTA |
|  | AAGTGATAAGTTTCAATAAGTTGAAAGAGGATTCCCGAACTCAAGTTCGATAAAGTGAAGAGGAT |
|  | CTGGAAGTGATTATGACCTTAAGCACGCTTCGAGATAGAGTACTTCGTGAACTTTGTGACTCAGGCCG |
|  | GCATCGATCAGTATAACTACCCTCCTCCGGGGTAAGACCTCGAGGACGTACTAAGAGCCAAGGAATG |
|  | AATGAGCAAATTAATCTATTTAAACAGCAGCAGACAGCAGGGATAAGGCTAGACACAGATCCCCAAGCTTATT |
|  | CCTCTTTTAAACAGATCCTAAGTGAAAAGGCACAGGATTCCCGAAAGCTTCATACCTAAGCAATTTGAAAGT |
|  | GATCAGGAGCTGTTTGACTCCTGCAAAAGCTGCACAACAATTGCCAGGACAAGTTACCGTGCTGCAG |
|  | CAGGCTATCCTCCGGACTGGCTCAGGCGGATCTTAAGACAAGTGTATTCATTAAGACTAGCGACCTCAATGCC |
|  | CTTAGTAGACACCATCTTTGAAAATTACTCCGTTTCAGCGATGCCCTCAATCTATACAAAGAGAGCTTGA |
|  | AGACTAAAAAGCTCAGGAGGCTTTTGAAAATTACCGGACAATCCACAGCAGCCAATCCACGACCTTATACATACT |
|  | TAGAGCAGTTCAACAGCAGCCGCTGACGTGACCTGCGAGAAGTGAGACCGTCTGAATTCAGCCTCT |
|  | TCAAAACCGATGAACTGTACTCCCGATTTATCAAGAGACGACCGCCAGAGTCTGGATATCTCTGGATAGCCTTCAGCCTCT |
|  | GTTCCAGCTGGAGGCACTGTTCCAGCAAGAGACGAATTAAGGCTTACTTGGATCCAGACGAGGCCAAGGGTC |
|  | AAGAGGGGTTTGAACAGATAAAAGCGAATTAAGGCTTACTTGGATACTCCATGGAGGCCGTGCATTTCG |
|  | CTAAGCCTTTTGTACCTGGTTAAAGGCCAGAAAATGATTGAGGGCGGCTAGATAAGGATCAGTCTTTTTACG |
|  | AGGCTTTTGAAATGGCCTACCAGGAATTGGAATCCTTGATCATTCCAATCTATAATAAAGCCCGGAGTTA |
|  | TCTGAGCAGGAAGCCCTTCAAAGCGACAAGTTCAAAATAAATTTGACAATATACGCTACTGTCTGG |
|  | TTGGGACGCTAACAGGAAAACAATGCTCATCCTGTTTAAGAAACGACCGCCTGTACTACCTGGG |
|  | AATTATGCCAAAAGGCAAAACTTTTTTGTCGATTACTTTGTCATCAGAGATAGCGAGAAGTTAAAG |
|  | CAAAGACGGCAGAAGACGCCGCAGAAGACCCTCGCACAAGGAGAATCATATTTCGAGAAATTCG |
|  | ATATAAGCTCCTGCCTGGCGATCATCAAAGATGTTGCCAACAAGTCTCTCTTTTCCAACAAAAAACATCGGCTTT |
|  | TATAACCCGCGATGATATCTTCGCATCCGGAACATCCGGAACCCGCCTCCACATAACAAAATGGAACTCCACAG |
|  | AAGGGCCACTCGAAGGTTGAATCAACCTTAACGATTGTCACAAAATGATTGATTTTTTAAGAGCTCCA |
|  | TTCAGAAACACCCCCGAATGGGGTGCTTCCTGGCTTCACCTTTTCGATACTTCAGACTTCGAGGACATGTC |
|  | CGCCTTCTACAGGAGGTGAGAACCAGGCTATGTCATTCCCTTCGACAAAATAAAGAGACATACAT |
|  | TCAGAGCCAGGTCGAGCAGGGAAACCTCGCTATACCTGTTTCAAGGCACTATAAAGGATTTCAGTCGTTAG |
|  | CAAGGCAAGCCCAATTTACATACCCTGATCTGCAGCATGCCCTGTTGCAAGCAGCATCAAGGCAACCTTAACAATGT |
|  | AGTTGCTAAGCTGAATGGGAAGCAGAGAGATCTTCTTCCGAAGGCACAGCATCAAGGCAACGACAAAG |
|  | TTGTACATCCTGCTAACCAGCCTGTAATACCAGGAATCCGATAACAAGAACCCGTATAACAAGAACACAGTCAACCTTTG |
|  | AAGCGCCACTCGTGAAGGACAAGAGGTACACACAAGATAAATTCTTCTTCCACGTGCCCATCAGCTTGA |
|  | ATACAACCTTGTAGAAGACAAGAGGTACACACAAGATAAATTCTTCTTCCACGTGCCCATCAGCTTGA |
|  | ATTTAAAGCGCAGGAGGTGAGCAAATTTAACGACAAGGTCAAGCGCTTCTGAAGGGAAACCCGAC |
|  | GTGAATATCATCGGAATTGATCGCGGTGAAAGACATCTCCTACTTTACTGTGTGAACCAGAGGGT |

TABLE 6-continued

SEQUENCE LISTING

| SEQ ID NO: | Sequence |
|---|---|
| | GAGATCCTAGTACAGGAGAGCCTGAACACCCTTATGAGTGATAAGGGCCATGTGAATGATTACCAGCAG |
| | AAGCTGGACAAGAAGGAGGAACAGGAAAAGGAGCACCAGCGCGGAAGTCCTGAGCACACTGTTGAGAATATCAA |
| | AGAACTGAAGGAGGAGGATATCTTAGCCATGTGGTACACAACCTGACATCTGATTATCAAGTATAATGC |
| | CATAGTCTGCCTGGAAGACTTGAACTTCGGTTTCAAGCGAGGAAGGTTTAAAGTGGAAGAAGCAGGTGTA |
| | CCAGAAGTTTGAGAAAGCCCTTATTGATAAGCTAAACTCACCCCCTTTCGAGTCTTTTAAGAAACTGGGAAGCAG |
| | AGTTGGCCACTATTTAACCCTACCAACTAACGACCCCCTTTCGAGTCTTTTAAGAAACTGGGAAGCAG |
| | AGCGGAATACTCTTCTATGTGCCTGCAGACTACACACCCCTCTAAGATGACCCCACTACCGGCTTTGTAAACT |
| | TTCTAGATCTCCGCTATCAGTCAGTGAGAAAAAGCCAAACAGCTCTTGTCAGATTTTAACGCCATCCGATT |
| | TAATTCCGTCCAAATTACTTCGAGTTCGAAATCGACTATAAAAAACTTACCCCCAAGAGAAAGGTTGG |
| | GACGCAGTCTAAGTGGGTAATCTGCACTTACGGTGACGTGAGATACCAGAACCGCCGAAACCAGAAAG |
| | GTCATTGGGAAACCGGAGAAGTGAATGCGCTGAGAAGCCCTCTTCGCTAGACAGTAAAA |
| | CAACAACAGTTATCGATTACGCCAATGACCATAATCTTATAGACCTGATCTTGAACAAGACAAAGCCT |
| | CTTTTTTAAGGAATTGTTGTGGTTGCTGAAACTTACAATGACCCTTAGGCACAGCAGCAAGATCAATCAGA |
| | GGATGACTTCATCCTCAGCCCGTGAAGATGAACAGGAGAGTTCTACGATTCACGGAAGGCTGGAGA |
| | GGTGTGGCCCAAGGATGCCAACTACGATGGGCTCTACCACATAGCTCTAAAAGGTCTGTGGAACCTGCA |
| | ACAAATCAATCAATGGGAGAAAGGTAAGACACTGAACCTGCCATCAAAAATCAAGATTGGTTCTCATT |
| | CATCCAGGAGAAAGCCTTATCAAGAGTGA |
| SEQ ID NO: 151 | ATGCATACGGAGGCCTTTTATCAATGGACGCAGAGAGTTCACCGGACCAGTATCCATTATCTAAGACA |
| | CTCCCGCTTCGAGCTGAGCCCCATTGGCAGGACCTGGGACAACCTGGAGGCGTCCGGCTACCTGGCTGAG |
| | GACAGACATCGCGCAGAATGCTATCCGAGACTAAGGAGCTTTTGACCGACAATCATCGCGCGTTCCTT |
| | AACCCGGTGCTCCCACAGATCGATATGGACTGGCACCCGATCGCTGAGGCTTTTGACCAAGGTCCATAAG |
| | AACCCTGGGAACAGAGCTCGCCCATGGCTACAAAGGGCTCTTCGCAAAGCCCGATCGAGCGAAAGAGATTTC |
| | TGCCTACCTTCAAGACGCCCATGGCTACAAAGTGACATCGAAGTTCTCGAAGCTCTCCGAAGCGATTTAGCGTGTA |
| | AATCCGAAGGAGAACGGAATGAGTCAAGGAGAATGAAGTGACATGAATATTTATAGCGACAAGTGAAGATCTTATAGCCCTACCG |
| | CTTTACCGGCTATCATGAGTCAAGGAGATAATTTGTTTCAAATGCCATAATAATTGACAAGTTAAATGAGAGCCAC |
| | CCAGAACATCATCTCGGAGGTCAGCCGCAACCTCGGAGTTGACGATATTGCAACTACTCCAGCTGAGC |
| | AACTATAACAACTTCTCCTCACAGGCTGGCATCGACGATGGCTTAATTAAGGCGGCCACACTACTG |
| | AGGATGGTCTCATTCAAGCAGCTCATTCAATGTAGTCTTGAATCTTGAATCGGCAACATCTAAAAGTTACATCCCCAAAC |
| | AGTTTGATAACTCAAAGGACGATGGTGGATTGCATATGCGATTATGTGCAAGTAATGTCAAAAATTGAAAAGAGCGAGA |
| | CTGTGGAGCCGGGCTCTGAAGCTCGAGCAATAGTCGATTCAGGAGAACATTAGCTCCTTTTGACCTTAGAGGAATTTTCGTCAATAA |
| | AAAGAATCTGAGGATCCTGAAGCGAGAATGATAAGAAGTCTGTCTACGATAGGATTGGGACGGCGCCATAGAGACAGCCATGATGC |
| | TCTTCTTCCGTGAAAAAATTTAGTAGTCGCCAGATAGGCGAAGCTCGAAGCCTTCACGCTGGACGATA |
| | GCAGGGTAATTTCAGAAGCTCAGATCAAGACCGCCTTCATGATCAGGAGTCGCAGAAATGCGGAATGCAGCCGAAGATATCT |
| | ACGATGGTTTACGAAGATCATCACCTGTTCTAAGATAAAGGCACGAGCTTTTGTACTCGCAAGCGCTA |
| | ACTTGAGATCTTTAGCGTGCCTGGGCGACAGCAGCAGCTTTCTATAGCCAGCTTTTCTAAGGAGGTGAT |
| | CAGCGACAATTAATCGAGATCATCACCCCCTGTTTAATAAGGCACGAGCTTTTGTACTCGCAAGCGCTA |
| | CAGCACCGACAAGATTAAAGCTGGGCCATCCTTAGAAAGGACGAAGTACATCTCTGGACCTAAACAAGGA |
| | ACGGATAATAAAGCCGCCATTCGTACTAGCGATGAAGAGAATCTCTTCGAAAAAATGGAGTAAAGCTGCTC |
| | AGATCGAGTTCCATTCGTACTAGCGATGAAGAGATCTCTTTGAAAAAATGGAGTAAAGCTGCTC |
| | CCCTCGCCAGTCAGTCTACCCAAGATCTTGTGAAGACCAGCCAAGGCAAGGAAAAGTACGGGCTG |
| | ACGGACAGGATGCTGGAGTGCTACGATAAGGAATGCATAAATCAGGGTGCAGCTTTTGACTGGGCTTT |
| | TGCCATGAGCTAATCGATTACTACAAGCCCTGTATCGCCCAGTATCGCAAGAATGGGACGTTTTCGACTTTA |
| | AATTTCGGAGAGTCTGATTATGGCTTCATTGAAGGAGTTTCAAGTAACAAGTGAGGAGAAATCTATATATTGTTTC |
| | CATGAGCCTTCGCAAGATCCTTTCCGAAGTCTACGGCTACTGACGGAGAGAAATCTATATATTGTTC |
| | CAGATATATAACAAGGACTACAGTGAGAATGCACATGGGAATAAGATAAGAATATGCATACTATGTATTGGAA |

TABLE 6-continued

SEQUENCE LISTING

| SEQ ID NO: | Sequence |
|---|---|
|  | GGTCTCTTTTCACCCCAAAATTGGAGTCACCCGTGTTCAAACTTAGCCGGTGGCCGCAGAGCTGTCTTTA<br>GGAAATCCAGTATACCCAATGACGCCAAGACAGTCCACCCAAAGGGTAGCCTTCTGGTGCCCAGAAAC<br>GATGTGAACGGCAGGAGAATCCCTGACAGCATTTACCGAGAAATTACCAGTACTTCAACGCGCGAC<br>TGTAGAATCCTGATGAGGCAAAGTCTTATCTGACAAATGATGTTTCACGTGCCTATCGCAATGAATCATGACATT<br>GTGAAAGACCCGCCGCTTTACTGTCGACAAAATGATGTTTCACGTGCCTATCGCAATGACCTCAAGATCATCG<br>TCTCAAAACCGAATCTGAACAAGAAGGTGATAGATGCATTATCGATGACCAAGACCTCAAGATCATCG<br>GAATCGACAGAGGTGAGCGAACCTGATATACCTGATAGAATTCGAAAAGCTCTCGATGTCAGGGAATACGACAACA<br>AGGATTCACTTAAGACATCCTCAATGGATATGACTATCGAAAAGCTCTCGATGTCAGGGAATACGACAACA<br>AGGAGGCGCACGAATTGGACAAAGTGGAAAGCATACGGAAGCATACCGAAGATGAAGGCTATCTGTCACTA<br>GCTGTCTCCAAATTGGCTGATATGATTATAGAGACAACAACGCCATTATCGTGAAGATCTCAACCAT<br>GGATTCAAGCAGCAGGAAGAAGTAAAATTGAAGCAGGTGTATCAGAAGTTCGAAAGACATGCTTATTAA<br>TAAGTTGGGTTATATGGTCTTAAAGGACAAGTCTATCAGTCGATCAGAGCGCCGCGACTACCATGGTATCA<br>GCTGGCTAACCATGTCACCACACTAGCATCCGTAGGCAACAGTGGCGTGATTTTCTACATTCCTGCT<br>GCGTTCACTTCTAAGATCGATCCTACCACGGGATTCGCAGACCTGTTCGCACTGAGCAATGTTAAAAACG<br>TGGCCTCCATGAGGGAGTTCTTTAGCAAAGCGTGAATTTATGACAAGGCGAGGCAAGTTCG<br>CTTTCACATTTGACTACCTGGACTACCAGTGGAGTTAATCGGAGTAATCAGATGCGGAGAACCCTGTGACCGTATACA<br>CGGTAGGGGAAAGATTCACTTACAGTCGAGTTAATCGGAGTATGTCCCTAAAGTGCCAACTGACATCA<br>TCTACGATGCCCTTCAGAAGGCTGGCATAAGTGTTGAGGGGATCTAAGGGACAGGATCGCTGAATCGG<br>ATGGGATACTCTCAAATCAATCTTTCTACGCCTTTCAAGTATGCCCTCGACATAGGGTAGAGAACCGGG<br>AGGAGGACTATATACAGTCTCCCGTGAAGAATGCGTCGGGAGAGTTCTTCTGCTCAAAAACGCCGGGA<br>AATCTTTGCCCAGGATTCTGATGCAAATGGGCTTATAACATTGAAAAGCATTGTCTCAAAGGCATCCTGCAGCTGCG<br>CATGCTATCTGAACATATGACCCAAACGCTAAAAGCTCCTGACATTAGATTGCCATTGATCAATAAGGCTTG<br>GCTGACTTTCATGCAGCAGCGGTATGAAGACATGAAAAACTAA |
| SEQ ID NO: 152 | ATGGATTCCCTTAAGGACTTCACAAATCTTCACCCCGTGAGTAAGTAAAACCCTGAGATTTGAACTCAAGCCCG<br>TGGGAAAGACTCTCGAGAATTCAGAAGGCCGGGATTTTGAAGGAAGACAGAGCATCGGGCGAAAGT<br>TACAGACGGGTGAAGAAGATTATAGAATACTTATCCAAGGTCTTTTAGAAGACAAGTGGCGGAAACATG<br>GCAAAGATGGGCATCGAAGACGAAATCAAGGCCATGCTGCAGTCCTTCTGCAGCTGTATAAAAGGAT<br>CATCCGACCCGAAGGCGAAGACAAGGCGCTCTGGATAAGAACAACTGTCAGGGCAGAATGAGAAATACGGAGAGTTTGTTCAA<br>TGCCTTCACTGGGGGTGTGCGGGCGGAGGAGAAACTCTGCCCGACTTCCTTAAGCACCAGAAGCCGAATCTCTCCATTCT<br>AGAGAAACTCATCAAGGAAATCTCCAGGTTCCCCTTAAAGAGTTCACACGTTCACTTCATCATACTTTGCCGGATTTTATGAAA<br>GTCGAGAAACTCATCAAGGAAATCTCCAGGTTCCCCTTAAAGAGTTCACACGTTCACTTCATCATACTTTGCCGGATTTTATGAAA<br>ACCGTAAAAATATATATCATCGACAATATACTCGTCTTTCAAAAATCAAGGAACAATCGCGAAGGAACTTGAAC<br>TGCCAAATTCATCGCAGACTTAGTGCGGAAGATACATCAAAAAGACAGCCGCCTCAAGGATAATATTTTCAC<br>ACATCGGCTGACTTTAGTGCGGAAGATACATCAAAAAGACAGCCGCCTCAAGGATAATATTTTCAC<br>TAAATTATTATTCATGTACTGAGCCAGGCTGCAGTAAAACCTTTAATTATATACAACAGCGGGGT<br>TGAACAGAAGGTGACGGGAAATGAAAGGCTAAACGAACATATTAACTTATATAACCAACAGCGGGGT<br>CGAGAAGATCGTCGTCGCCCTGTTCAGACCTCTGTATAAGCAAAATACTCTCCGACAGAGAGCAGCTATCA<br>TATCTGCCCAGTCCCTTTGAGAAGATGAAGAGCTTGCTCCGGGCCTCAAGGAGTTCTATGATCATATA<br>GCCGAGACATTTTGGCCAGAACCTCATGAGCTCTATTTCTGAATATGATCTGTCTCTATCT<br>ATGTCAGGAGATGGCGCAGCTGACCGATATATCAAGAAGATGCTGGGGGACTGAACACCCATTTATA<br>TGGCCAGGAGGCGAGCATACGATCAGCAGGCAGATCAGTCTGCCAATCTGACTCCTGCATAGCTTCCTT<br>GATAACGTGAGGGATTGCAGAGTTGATACTTTACCTGAGTACCCTGGGCCAGAAGGAAGGCCTCACGGC<br>CTCTTAATCTAGTGGAGAATTAATACAGGATAAGGACAACCTAGTGCTTATCAAAAATCTACTGGATAACATTT<br>CAGAGGAAAATTTAATAATCAGGATAAGGACAACCTAGTGCTTATCAAAAATCTACTGGATAACATTT<br>CCGACCTCCAGCCGCTTTCCTCAAACACCTTTGGGGATGGGCGACGAGCCTGATAAGGATGAGCGCTTTT<br>ACGGACGAGTACAACTACATCAGGTGACCAAGCCCTTGGGACCAGGTGATTCCCCTCTATATAATAAGTCAGGAATT<br>ACCTGACCCAGAAGCCATACAGTAGAAGACACAGTAGTAAATTTCGGAATGTAAATTTCGCAATAGTCAGCTGCTGTCTG |

TABLE 6-continued

SEQUENCE LISTING

| SEQ ID NO: | Sequence |
|---|---|
|  | GTTGGGACCGAAATAAGGAGAAAGACAACAGCTGCGTAATTCTCAGAAAAGGACAGAACTTTATTGG<br>CCATCATGAATAACAGACACAAGAGATCTTTCAGACAACAAAGTGCTCCCTGAATCAAAGTAAGGAGGGGGAA<br>CCCTACTTCCAGAAGATGGACTATAAATCTCTTCCTGATCCAAATAAAATGTCGCTAAAGTATTCTGT<br>CAAAAAAAGGTATAGAAATTCACAAACCTTCACCTAAGCTACTTGAACAGTATGGCCACGGCACCCATA<br>AAAAGGGACACGTTCAGCATGGACGACCTACAAATTCCAGATACCGAACTGACTTCTTAAGCACAGCATGAAG<br>CTCATGAGGACTGGAAAACAGTTCGGATTCAAATTCTCAGATACCGACCTACAAAAGTTACGTCTAGTT<br>TTTACGAGGAAGTCGAGGACCAGGGCTACAGTCTCAGCTTCAGAAAAGTTAGCGAATCTTACGTCTACT<br>CCCTTATAGATCAAGGTAAGCTGTATCTCTTTCAAATCTACAACAAGGACTTTTCCCATGTAGCAAGGG<br>CACCCCAATCTGCACACTCTCTACTGGCCGGATGCTGTTCGACGAGCGTAACCTGGCAGACGTGATCTAC<br>AAATTAGATGGTAAAGCTGAGATCTTCTTTCGTGAAAAGAAGAACGATCACCCCACTCACCCC<br>GCCGGAAAGCCCATTAAGAGAAAAGTAAAGAGAAGAAGGAAGAACTGCTATTTGAGTACGACCCT<br>CGTCAAGGATCGGCATTATACAATGGATAAGTTCCAGTTCCATGTGCCAATAACTATGAATTTCAAGTGC<br>AGTGCTGGCAGTAAGGTGAATGACATGGCTAAACGCTCATATCCGGAGGCAAAGGACATGCATGTTATT<br>GGAATTGATAGGGGTGAGCGTAATCTCTCTACATCTGTGTTATTGACTCCCGGCACAATCCTCGATC<br>AGATTTCCTTGACATACAATTAATAGATATAGACCATGACTTCGTGACTCTCGCGACAAAGATAGACA<br>GCAGGAGAGAGAAATTGGCAGACATCGAAGGCATCAAGGAACTCAAGCAAGCCTACCTTCTCAGG<br>CAGTGCATCGAATAGCCGAGCTGATGGTGGAATCATCCGTATACCAGCAGTTCGAAAAACAGTTGATAGAC<br>AAACTCAATTACCTTGTAGACAAGAAGCGGCCTGAGGACATAGGGGCTGCTTAGAGCGTATCAA<br>TTTACAGCCCCATTCCAAGTCTTTCAAAGAAATGGGTAAACAGAACGGTTTCTGTTTTACATCCCAGCGT<br>GGAACACCCAGCAATATAGATCCAACCACTGGCTTCGTCAATCTGTTTCATGCTCAGTATGAAAATGTGG<br>ACAAGGCCAAATCCTTCTTTCAGAAATTTGACAGCATCTCCTATAACCCAAAGAAAGACTGGTTTGAATT<br>CGCCTTTGACTATAAGAATTTCACTAAGAAGGCCCAGAGGATCAAGAAGCATGTGGATATTGTGCACGCA<br>TGGCTTCACGTATAAAGAACTTTAGAAACTTCTTCTCGTCCGTATGAGATCGATTACTTAAGCTAACCGTTCAGATGCGA<br>CACCGAGGCTTTCAAATCCCTTCTTGTAGATCTACTTCATTAGTCCAGTCAGTGCCGCGATGGTAGATTTTC<br>GTCGACGAGAAACAGAAAAGGATCTGACTATCTCATTAGTCCAAAGACCGCCAACATCTGAAGGCTAACATATTGCACTA<br>AACAGTTGGAAGAAAAGGATCTGACTATCTCATTAGTCCAAAGACCGCCAACATCTGAAGGCTAACATATTGCACTA<br>GATACCCGGGAAGGTAACAAGTCCCTTCCCAAAGACCGCCAACATCTGAAGGGGCAAGCTTAAGCTGGCTATTTCT<br>AAGGGGCTCTGGGCCTGCGCAATTAGACACAGACATCTGAAGGGGCAAGCTTAAGCTGGCTATTTCT<br>AATAAGAGTTGGTTGCAGTTTGTGCAGGAAGGAGTTATGAGAAGGACTAG |
| SEQ ID NO: 153 | ATGAACAACGGCACCAACAACTTCAGAACTTCATCGCATATCTGTCTCTGCAGAAAACACTTAGGAAT<br>GCCCTGATTCCAACTGAGACAACACAGCAGTTTATTGTGAAGAATGGATCATCAAAGAGGACGAATTG<br>CGCGGGAGAATAGGCAGATCCTGAAGGACATCATGGACGATTACTACAGGGGTTTATCTCCGAAACG<br>CTGAGCTCGATTGACGATATTGACAGCTGGACGTCCCCTCTTTGAGAAGATGGAAATCCAACTTAAAATGGC<br>GATAATAAAGATACCCTGATAGATAGACAAACCGAATATAGAAAGGCTATACACAAAAATTCGCAAA<br>TGACCACCGCTTTAAGACATGTTTTCTGCAAACTGATTAGCGATATTCGCCCGAGTTTGTGATTCAC<br>AATAATAACTATTCCGCTTCGAGAAGGAGGAAAAGACTCAGGTGATTAAACTGTTTTCGGTTCGCC<br>ACTTCTTTCAAAGATTATTTCAAAAATCGCGCCAACTGTTTTTCCGCTGACGACATCTCCTCCTTCCTG<br>CCACCGGATCGTAAACGACGAGATCTTTTTTAGTAACGACGCCCTTGTGTATCGGAGGATAGTGAA<br>GAGCCTGTCCAATGATGACTAAACAAAATTTCGGCGATATGAAGGATAGCCTCAAAGATGAGCCT<br>TGAAGAAATTTACTCCTACGAGAAGTATGGGAGTTCATCACCCAGGAGAATAAGGAGAAAACAAAATCGTA<br>CATCTGTGCAAGGTGAACAGTTCGATACCTGTCTATCCGGGATACCTCATATGAGGTTCCTTATAAGTTC<br>GAGAGTGATGAAGAAGTGTACCAGTCTGTAAATGATTCTTAGACAATATTCGTCAAACATATAGTG<br>GAGAGACTGAAAGATCGGGAGACAATTACAAACCATACAGGGATTGGGAAACCATTAATACCGCGCTTGAATTCAC<br>TTTTACGAATCTGTGAGCCAGAAAACATACAGGGATTGGGAAACCATTAATACCGCGCTTGAATTCAC<br>TACAATAATTCTGCCTGGCAACGAAAAGCAAGGCCGATAAGGTAAAAAGGCAGTCAAAAATGA<br>CCTTCAGAAAGTATCACCGAAATCAATGAGTTGTGAGCAACTACAAATTGTGTTCAGACGATATAT |

TABLE 6-continued

SEQUENCE LISTING

| SEQ ID NO: | Sequence |
|---|---|
| | TAAAGCGGAAACGTACATACATGAAATTAGCCATATTCTGAATAACTTTGAGGCGCAGGAACTTAAGTA<br>CAACCCTGAAATTCATCTCGTCGAAAGCGAATTGAAGGCCTCGAATTGAAAAACGTTCTTGACGTGAT<br>AATGAACGCTTTCCATTGGTGTCTGTGTTTATGACTGAAGAGCTGGTTGATAAGGACAACAACTTTAT<br>GCTGAACTTGAGGAAATCTACGACGAGATCTACCCTGTGATTAGCTTGTATAACCTCGTCAGAAACTAC<br>GTTACCCAGAAGCCGTACAGCACAGAAAATAAAGCTGAACTTTGGTATTCCGACTCTCGCCATGGA<br>TGGAGCAAGTCGAAGGAATATTCCAACAATGCCATCATTCTATGCGAGACAATCGTATTACCTCGGC<br>ATCTTTAACGCCAAAAACAAGCCGATAAGAAAAATCATTGAAGGGAATACGAGCGAGAATAAGGCGA<br>CTATAAGAAAATGATCTACAACTTACTGCCAGTCCCAATAAAAATGATTCCTAAGGTGTTTCTGTCATCG<br>AAAACAGGTGTAGAAACATATAAGCCACCAGCGCATACATCTGGAAGGCTACAAGCAAAACAAACAT<br>CAAAAGCAGCAAGGACTTTGATATCGATTCTGCCACGATCTAATCGACTACTTCAAAAATTGCATGCC<br>ATTCACCCTGAGTGCAAGAACTTCGCTTTGACTTCTCCACACCGACTACGAAGACATTTCTGGAT<br>TCTACCGTGAGGTTGAGCTGCAGGGTTATAAAATTGACTGGACATACATCAGTGAAAAGACATCGATC<br>TACTGCAGGAGAAGGGGCAGCTCATACAATGTATCTCTTCCAGATTTATAATAAGGATTTCAGCAAGAAGTCCACTG<br>GAAACGACAATCTGCATACAATGTATCTTAAGAACTTGTTTAGCGAAGAGAATTTGAAAGATATCGTTC<br>TAAAGTTAAACGGGGAAGCCGAGATTTCTTCGAAAGTCTTCCATTAAGAATCCAATTATTCACAAGA<br>AGGGCAGTATCCTGGTCAACAGAACCTATGAGGCCGAGAGAAAGGACCAGTTCGGTAATATACAAATT<br>GTGCCAAGAACATCCCGACGAGCTGCCAAGCTGAAAACGTGGTGGGACACCATGGACACAGCCACCACATCGTC<br>AAAGATTATCGTTATACATATGACAAATATTTTCTGCACATGCCTATTACAATAAACTTTAAGGCAAACA<br>AGACCGGGTTCATCAATGACCGGATACTCCAGTACATCGCAAAAGAGAAGGACCTGCATGTGATGGCA<br>TCGACCGCGTGAAAGAATCTCATTGACGGCTATGACTATCCAGATCAAGCTCAAACAGCAGGAAGGTCTCGTCAGA<br>AGTCCTTCAACATTGTTAACGGCTATGACTATGACTATCAGATCAAGCTCAAACAGCAGGAAGGTGTCTCGTCAGA<br>TTGCCAGGAAAAGAATGGAAAAGAATCAAGGAGATCAAAGAAGGGTATCTGAGCTTGGTC<br>ATTCACGAGATCTCCAAAATGGTCATCAAGTACAACGCCAGGTCTATCAGAGATCAGGTATCAATAAGC<br>TTAAGAAGGGGCGCTTAAAGTGAGCGGCCAGGTTCCTATCCAGAACGGAGGACTGCTGAAAGGTTACCAGCTCA<br>CGAATTACTTGGTCTTTAAGGATATCAGTATCACCGAGACACGGAGGACTGCTGAAAGGTTACCAGCTCA<br>CATATATTCCCGATAAGCTGATCCTACCACCGGATCTCAATATATTTAAATTTAAGAAGATGTTGATGCC<br>AAGCGTGAGTTTATTAAGAAATTTGATTCAATCAGGTACGACAGCCAAGTCATCATGGAGCGTTTATACTTATGG<br>TCGACTACAACTTCATCACACAAAATACTGTGATGAGCAAGTCATCATGGAGCGATACAATAGACATCACAAA<br>AGAACATGGAGAAGACACTGGAGATACAGATATTAATTGAGGACAGACGGTAAATTCTCCAGAGACA<br>TCATCGACTACGAAATCGTCCAACACATTTTGAGATATTCAGACTCACTGTCCAGATGCGAAACAGCCT<br>GTCGGAACTCGAAGACCGGGACTACGATACGTCCTCCCGGTTGTTAAACGAAAATATATTTTCTA<br>CGATTCGTCAAGGCAGGAGACGCTTCTCTAAAGATGCGACCGCCAATGGCCTTACTGTATAGCGTT<br>GAAGGATTGTATGAGATTAAAGACACTGGAATTAAAGACGAGACGGTAAATTCTCCAGAGACA<br>AGCTGAAAATCTCCAACAAGACTGGTTTGATTTTATTCAAAATAAGCGCTACCTGTAA |
| SEQ ID NO: 154 | ATGACAAACAAATTTACTAATCAGTACAGCCTGTCCAAAGACCCTCGCTTCGAACTGATTCCACAAGGG<br>AAGACCCTTGAATTCATCCAGGAAAGGTTTATTATCCCAGGATAAACACGCGCAGAAAGCTATCAA<br>GAGATGAAGAAGACGATCGATAAATTTCATAGATTTTCATAGATTTAGCCCTGAGCAACGCTAAATTG<br>ACCCACTCCGAAAACTATTTGAGCTGTACAACAAGTCAGCCGAGACAAAAGAAGAGCAGAAGTTTAA<br>GGACGACCTGAAAAAGTACAGGAACAATTTGCGAAAAGAGATCGTCAAGTCTTTTCCGACGGAGAGC<br>CAAGTCAATATTTGCCATCCTGGACAAAAAGTCATCACTGTGGAGTTGAGAAGTGGTTTGGAA<br>TAATGAGCAGGAACATGTACTCTGTTGAGCCGAACTCAAGACATTTACTACTTCACCGGATTCAC<br>CAAAACCGAAGAACATGTTCTGAGAATGCTAAAGCCTTTGAGAAAAATTAAGCAGGTCGCTCCAGGTG<br>AACTTTGCGAAAGTTTCTGAGAATGCTAAAGCCTTTGAGAAAATTAAGCAGGTCGCTCCAGGTG<br>AACTTTGCGAGAAGTTTCTGATGGTGAATTCGGGAGCGAGGGCCTGATTTTCGTGAATGAACTCGAAGAGATG<br>TTTCAGATCAACTACTATAATGATTACTCCAGAACGGATCACTCTACACAGCATTATCTCTG |

TABLE 6-continued

SEQUENCE LISTING

| SEQ ID NO: | Sequence |
|---|---|
| | GATTCACTAAGAACGATATCAAGTATAAAGGGCTGAATGAATACATCAACAATTATAATCAGACTAAGG |
| | ACAAAAAGGACAGGCTGCCTAAATTGAAACAGCTTGTATAAGCAGATCCTCAGTGATGATAGAATTAGCTT GT |
| | CATTTCTCCAGATGCTCTTACTGACGGAAAGCAGGTGCTTAAGGCGATATTCGATTTCTATAAGATCAA |
| | CCTCCTCCTTATACAATGCAGGGCCAGAGGAGTCACAGAGAACCTCCTGCTCCTGATTCGACAAACTATT |
| | GAAAATCTGTCCCTCTTTCGATACCAGAAGATATACCTGAAAAATGACACCCATCTCACTACAATATCCC |
| | AACAGGTATTCGGAGATTTCTCCGTCTTCAGTACAGCCCTGAATTACTGGTACGAGACAAAGGTGAACC |
| | CTAAGTTCGAAACAGATCAGCAAGGCGAACGAAAAGAAGAGGAGAGATCTGCAAGCAAAGCCAAAGC |
| | CGTTTTCACCAAGGCAAGATTACTTTAGCATCGCATTTCTGCAGGAAGTCCTGTCTGAGTACATACTGACA |
| | CTCGATCACACAAGCGACATAGTTAAGAAGCACTCTTCCAATTGTATCGCGGACTACTTCAAAAATCATT |
| | TTGTCGCGAAAAGGAGAACGAGACAGATAAGACCTTGCATTTTATCGCGAATATTACCGCAAAGTATC |
| | AATGCATTCAGGTATCTTGCAGAACGACCCGACCAGCGAGCTTAAACAGGATCAGAAGCTC |
| | ATCGACAACCTAAAGTTCTTTTTGACGCTATACTGGAACTCCTCATTTTATTTAAGCCACTACATCTGA |
| | AGAGTGAGTCTATCACTGAGAAGGACACTGCTTTTTACCACGTTTTCGAGAATTACTACGAAGCACTGTC |
| | TCTGCTAACCCCTCTGTATAACATGTGACACAGAAACATGTTGACACAGAAACCTTATAGTACCAGAGAT |
| | TAAGTTGAACTTCGAGAACGCACAATTGCTGAATGGGTGGGATGCAAACAAAGAGGGTGATTACCTCAC |
| | AACAATCCTCAAGAAAGATGGCAATTACTTCCTGCCATTATGAAAAGATGGTATACAAGTTGCTGCCCGGGTGAACAAAA |
| | GAAATTTCCCGAGGGAAGGAAAATTATGAAAAGATGGTATACAAGTTGCTGCCCGGGTGAACAAAA |
| | TGCTCCCGAAGGTGTTTTCTGAATTAAGATATCGCTACTTTAACCCGTCCAAGGAACTGTTGGAAAA |
| | TTATAAAAGGAAACAACACAGCGATTTGAAGTACTTTTAATTTGGAGCACTGCCACACACTCATTGACTT |
| | CTTTAAAGATAGTCTCAACAACATGAGGATTGGAAATATTTGACTTTCAGTTTAGCGAGACCAAGTCT |
| | TATCAGGATCTGTCGGGATTTATAGGGAAGTTGAGCGAAGGGAAGCTGTTCCTGTTTACAGCAAAGAT |
| | GATAGCGAGTACATTGACCGGACTGTGAACGAAGGGAACATGCATACCCTGTTGAAGGCCCTGTTCGAGGAGCAAA |
| | TTCTCCTTTCTCAAAAGCCACATTGCCGAACATGCATACCCTGTTGAAGGCCCTGTTCGAGGAGCAAA |
| | ACCTTCAGAATGTGATTTACAAGCTGAACGTCAGGCCGAGATTTTTTTAGGAGGCCCTCTATCAAGCC |
| | CAAAAACATCATTCTGCACAGAAAAAGATAAAGATCGCCAAAAAACACTTCATTGATAAAACGACAA |
| | AGACTTCTGAGATCTACCTGTTCAGAACAATCAAGAATCTCAAGATCTATTATCAGGGAAGATTAGCG |
| | AGAAGAGTTGACACAGGACGCGATTTGAGGTACATCGACAACTTCTCTATCTTTAACGAAGAACAAGA |
| | CAATCGATATCATCAAGGACAAGCCGTTTTACCGTCGATAAATTCCAGTTTCATGTGCCTATCACGATGAA |
| | TTTCAAGGCCACCGTGGGAGTTATATCAACCAGACTGTCTGGAGTATCGCAGAACAACCCGAAGT |
| | AAAATTATTGGCTGACAGAGGAGAGCGGCATCTGGTGTACTTGACCCTCATCGATCAGCAGGAA |
| | TATCCTGAAACAAGAATCTCGAATACTATTACGGACTCCAAAATCAGCACACCTTACCACAAGCTGCTT |
| | GATAATAAAGAGAATGAGAGGGACTTGGCCCGCAAAAAATTGGCCGCACCGTCGAGAATATTAAGGAATT |
| | GAAAGAAGGATACATCTCACAGGTGCTTCACAGGTCGTGTTAGAAGAACGCTATTGT |
| | GGTGATGGAGGACTTAAACTTCGGATTTAAAAGAGGAAGATTTAAAGTCGAGAAACAGATTTATCAGAA |
| | ACTGGAAAAAATGCTATTGACAAATTAAATTACCTGGTCTGAAAGATAAACAGCCACAGGAGCTGGG |
| | TGGCCTGTATAATGCTCTGCACTGACCACAAGTTGACTTGTTTCAGAAAATGGGCAAGCAGTCAGG |
| | CTTCCTTTTTTACGTGCCCGCTTGGAACACCTCAAAAATCGACCCTACAACAGGCTTTGTGAATTATTCT |
| | ATACCAAGTATGAAAACGTGGACAAGGCAAAGGCAAATGGACAAGGCTTTTTCGAGAAGTTTGAAGCAATCAGGTTCAATG |
| | CCGAGAAAAAATACTTTGAGTTCGAGGTCAAGAGAGTTCATACAATTAGCGACTTCAACCCTAAGGCCACGC |
| | AACAAGCCTGGACAATATGCCACGTATGGGGAGGAGAATAAGCCCGCAGAAGGATCAGAATAAC |
| | AAATTCGTGAGCACACCGATTAACCTGACAGAGAAGATAGAAGACTTCCTCGGCAAGAATCAGATCGTG |
| | TACGGCGACGCAATTGCATCAAGTCACAATTGCATCTAAAGATGACAAAGACAGATTCTTCGAAACACTG |
| | CTGTATTGGTTCAAGATGAATGACTAACCGACACGTTTTACAATTCCCGGACTCATGATATCATCCAAAGAAGAACCCGACA |
| | AGCCCTGTGATGAATGACTAACCGACACGTTTTACAATTCCCGGACTCATGATATCATCCAAAGAAGAACCCGACA |
| | CTGCAAAAGACGCCCGACGCAAAATGCATATCATCCAAAGAAGTTTAGTGCGTTGTTGAACAAA |
| | ATTGATCAGGCTGATCTGACCAAAAAAGGTCGATCGTGATCAGTAACCCGACTGGTTGCAGTTTGTC |
| | CAGAAGAACAAATAA |

TABLE 6-continued

SEQUENCE LISTING

| SEQ ID NO: | Sequence |
|---|---|
| SEQ ID NO: 155 | ATGGAACAAGAGTACTATCTGGGCTGACATGGGCACCGGGAGTGTCGATGGCAGTCACCGACTCA
GAGTACCACCTCCTCAGAAAGCACCGTAAGGCACTTGGGGAGTGCGACTCTTCGAGTCCGCTAGTACT
GCTGAAGAGGAGGATGTTTCGAACTTCCAGGCGCCAGGCTGGATCGGCGAAACTGAGAATAGAGAT
TCTCCAGGAGATATTTGCTGAAGAGATTCAAAGAAGGATCCTGTTTTTTCCTGCGCATGAAAGAATCT
AAGTATTACCCCGAAGATAAACGCAATCAACGGCAATCAAGAAGATCAACGGCCTATGCCTGTTTGTCG
ACAGCAGATTTCACCGACACAGATACCAAAGATACCACCATATACCACCTGAGAAAGATGTTGA
TGAACACCGAGGAGAGACACCCGACATAGTCTGGTTTACCTGGCTATCCATCATATGATGAAGCACCGCG
GGCATTTCCTGCTGTTCTGGAGACATCAATGAGATAAAGAATTTGTACTACGTTCTCCAAGTTGTTAGA
AAACATTAAGAATGAAGAGTTGGACTGGAATCTTGAACTGGGAAAAGGAAGAGTATGCAGTTGTAGAGT
CGATTTTGAAAGATAACATGTTAAACGTGACAATCTAAGAGAAAACCAGGTTAATTAAGGCACTAAAGGCCA
AATCGATATGCGAGAAGGCTGTGCTAAATCTGCTCGCTGGAGGCACCGTGAAAACTGTCTGATATTTTCG
GCCTGGAAGCTCAATGAAACGACTCGGACGGCTAAATCTTCTTTGCCGATAACCGCTAAGGCAGTCTATGACT
GGGCCGTGCTCGTCGAGATTTTAGGCAAGTACACCAGCATTGAAGCAAAGGTGGCTACCTATGAAA
AGCACAAATCGAACCCCAGTTTCTGAAAAAGATTGTGCCAAATACTTAACAGAAGAGTACAAGG
ACATCTTTGTGAGCACATCAGATAAGCTCAAGATAACTCAGCATACATTGAATGACAAAGATTAACG
GGAAGAAGGTGGATCTCCAAAGACAACGTTGTTCAAAGGAGGAGTTTTACGATTTCATAAAGAAGAAC
GTGCTGAAGAAACTGGAGGGACAACCGGAGTCAGAGTATTTAAAGGAGGAGCTCGAGCAGAAACTTT
CCTGCCCAAGCAAGTTGAACAAGAGACAATGGTGTCATTCCTTACCAGATTCACTTATATGAGCTGAAGAA
AATCCTGGGGAACTTGAGAGACAAGATAGACCTGCTCCAATAAGATCGACGACGGCAAGGAAGCCAAATTCAC
CGAATTCAGATCCCATATTACGTCGGCCCGCTCAATAAGATCGACGACGGCAAGGAAGCCAAATTCAC
TTGGGCGTGCAGAAAAGCAACAGAAAATATACCCAAGGAACTTTGAGAACGTCGTTGACATCGAGG
CCAGCGCCGAGAAATTTATAGAACGCATAGCTATACAGGAGGCTGTAACGAGCTGAATAATGTTACTTCATGGGCGAGATGTTCTGC
CCAAGGACAGCCTGCTGTATTCCAAGTACATAGAGGCTGTAACAGAGCTGTACACTGATGTGTTTCAAGTATCGGAAAGTTACCG
AGAAGCTCAGCGTGGAGCTTAAACAGAGGATCATTTCCGGCAACGGATCATTTCCAAGTATCGGAATTACCGGAATCG
TTAAGAAGATAAAGATTACCTGAAGCTGTTGACCGCTCGTTGACCGCCTATCATTCATGATGATCATTTCAAGGAGAGATTTTAACCGCACGAGCTCGC
ACGGCGATTTTAAGGCTGCGCGCTCGTTGACCGCCTATCACGAATATAGTTCTGTTTGGGGACCGATAAAAAACTTCTTAAA
AACGACTCAATGCTGACTGATCCGACGATTATCCCCAAGCAGCTGAAGAAGATTTTGCGCTCGAGCTATA
CCGGGTGGGCCCGGTTCTCTAAGAATTCCTGCAGAGATCACACCCCAGAGACTGGTGAGG
TGTGGAATATATTACAGCTCTGGGAATCCAATAATAACCTTATGCAATTGTTGAGCAATGAATATAG
GTTCATGGAAGAAGTGGAAACTCCCCCTTCAGTGAAACGGCAAATCTGGCAAACTTCTGGAAGATCGTGAAGGAGCTCGA
GAATATATGTCTCCCCTTCAGTGAAACGGCAAATCTGGCAAACTTGAAGATCGTGAAGGAGCTCGA
AAAAGGTGATGAAGAGAGCCGAAGAGTGGAAGGGTTTTATTGATTGTATAAAGCCTGATAAATGCCAGAGAAACAGGAGAGCAAGA
GAACAGAGTAGGAGGAGAAGCAGCTAATCGATTTGTATAAAGCCTGATAAGCTGTACTTATATTATACCCAG
GTCAAGGAGCTAGGCGATCAGGAAGGAACACGAAGTTGCGCTCGATAAGCTGTACTTATATTATACCCAG
AAAGGACGGTGCATGTACTCAGGGTGAGGTCATTGAGCTGAAGATCTGTGGGACAATACTAAGTATGAT
ATTGATCACATCTACCCTCAGTGAGACGACTTCCTAACAACAGCGGTGTTGGTTAAGAAG
AAATACAATGCTAACAAAGTCCGATAAATACCCTCTTAACGAAAACATCCGGCACGCAAAGAAAGGGCTTC
TGGAAGTCCCTGCTGGATGGGGTTTATCAGTAAAGAAGTATGAGAGGCTGATCCGAAATACCGAG
CTCTCCCCGAGGAACTGGCTCGTGTTTCCTGAGTCAGAAATCTGGAGACTACGTCAAAGCTGCACAGTGTCA
CGGTTCCAAAGGACTTTGAGTTGTTAAAAGTTCGGGAGGTGAATGAACCTGCCACCGCTAAGACGCC
TATCGAATATCGTTGTGGGCGACCTATAACCTTATTATGTTAAGTTACTAAGAATGCGTCCTGTTTATTAAGG
AGAACCCGGGGCCACCTATAACCTGAAGAAGATGTTCACCTCCGGCTCAAACAGATTATGAACAAAACAA
GAAGTCGCGTGGGAGGTGGGTAACGGGTGCAAAGGGGCTCTTTGACATCAGCAGATTATGAAAAAGGG
CATATTGGTAACTCGCCAGTGCATGAAGCCGACATCGGCGAATCAAGGAAGCCGACAAGGGG
CAAAGGACAGTCGCAATCAAGGAAACCGACGAGCGCCTGCATCATTGAGAAGTACGGAGGCTACA |

TABLE 6-continued

SEQUENCE LISTING

| SEQ ID NO: | Sequence |
|---|---|
| | ACAAGGCGGCAGGTGCGTACTTCATGCTCTCGAGTCGTCCAAAGATAAGAAAGGCAAAACTATTAGAACA<br>ATCGAGTTCATCCCCTATATTTGAAAATAAGATCGAAAAGTGACGAAAGCATGCCCTTAACTTCTTGG<br>AGAAGGGCCGGGCTTAAAGGAACCAAAGATTCTCTCAAGAAGATCAAGATCGACACACTCTTCGAT<br>GTGGATGCGTTTAAGATGTGGCTGCAGGACAGGGGATCGCTTGCTGTTCAAATGCGCAAATCAG<br>TTGATTCTGACGAAAGATCATTGTGACGATGAAGAAGATCGTTAAATTCATTCAGCCGACGACAGGAA<br>AACGAGAACTGAAACTCTCCGATAAGGAGTGATTGACAATGAAGTCCTCATGGAGATTTACAATACC<br>TTTGTGGAACAAGCTTGAGACACACTGTCTATCGAGTATCCGACTGTCCGAAGAGACTCTGATCGAC<br>AAACGAGAAAGAATTCGAAAGAATAAGCTTAGAGACAACTAAGGTTCAACTCTCTTTGAAATTCTCCACATC<br>TTCCAATGTCAAGTAGTGCAGCCAACTTGAAGATGATCGGGGGTCCCGGCAAGGCTGGAATCTTAGTC<br>ATGAACAACAACATCTCCAAATGTAACAAAATCTCCATCATAACCAGTCTCCCACCGGCATTTTCGAG<br>AACGAAATTGATTTACTCAAG |
| SEQ ID NO: 156 | ATGAAATCTTTCGATTCTTTCACCAACCTCTACTCCCTTAGCAAAACCCTTAAGTTTGAAATGAGGCCG<br>TGGGGAATACACAGAGAGATGCTTGACAATGCTGGCCGTCTTGCAAAAGGACAAATTAATCCAGAAGAAGT<br>ATGGTAAAACAAAGCCATATTTGACGAATGCAATCGGGATTCATTGAAGAGGCTCTTACAGGAGTAG<br>AATTGATCGGACTGGACGAGAACTTCCGTACCTTAGTAGACTGCAGAAGGACAAGAAGAACAACGTG<br>GCAATGAAGGCTATGAGAGAATAAGTACCCGATCCTGGGACTGAAAAACAAAAACACAGACATCTGTT<br>TGAAGAAGCCGTCTTTGGTATCTTGAAGGCCAGGTATGGAGGTAAGATCAGTTTATAGAGGTAGA<br>GGAGATTGATAAAACAGGCAAGAGTAAGATTAATCAGATCAGTATCTTTGATTCTTGAAGGGGTTCAC<br>AGGCTACTTTAAGAAGTTTTCGAAACCAGGAAAAATTCTATAAGAACGATGCACTCCACAGCTAT<br>CCGACACCGCATCATAGATCAGAATCTGAAACGGTTCATTGATAATCTGAGCATTGTTGAATCCGTGCG<br>CCAGAAGCTCGACTAGCTGAGAACTCTTCGAGAGTCTTCTTCTCTATATCACTCCCAGTTCTTCTCAATAGAT<br>TTTTATAATAAGTGCCTTCTGCAAGATGGCATAGACTACTATAACAAGATCATCGGCGGCGAAACTCTCA<br>AAAACGGTGAAAAGCTCATTGGCCTGAAATGAGCTCATCACAAATATAGACAAAATAACAAAGGATCAG<br>AAATCCCATTCTTTAAGCTGCTAGATAACAGATCCTATCAGAAAAATCCTGTTCCTCGACGAAATCA<br>AAACGACACCGAACTCATCGAGTCTCTCGCAGTTTGACCAAGACGCTGAAGAACGGAAGATT<br>GTGAAAAGCTGTTTGCAGACTTTGGAACAAGACCAATTGGACAGTCTTGGCTATTTTCTATACGAGTT<br>AGGAAGCATTTAACAATTCCAATAAGTGGACTAGCCGAGAACTGGAAACCTTCGCCAAATACCTGTTCG<br>AGGCCATGAAAAGCGGCAAGCTCGCCAAGATCCGCGCTACTTAGCAATACGAGAAGGACAATTCCTATAAGTTTCCGATTCA<br>TCGCATTATCTCAGATGAAGTCCATCACCAATTGGCAGCAGTCTTGCTCATTTTCTATACGAGTT<br>ACTAAAGATTTCCAAATTCAAGAAGAACCAATTGGGACAGTCTTGGCTATTTTCTATACGAGTT<br>CAACTCTTGTTCAGTGACAAGATCAACACTAAGGACGGTGAGACCGTAAACAAGTGGGTACTACCCTTT<br>CGCCAAAGATCTTCATAACCTGACTACTGTCCGACAGATCGACATACCCAAGGATTCAAGGTGACCAT<br>CAAGGATTTTTGCGATTCGGTATTGCGACGATCTATCGACATGATGGCGAAGTATTTCGCTGTCGAGAAAAGCG<br>GGCATGGCTGGCCGAATACAGAGTTGGACACTCCTTCTACTACCGATACAGGGTACCTGCAGTTTTAC<br>GATAATGCATACGAGCATACGAGGATATAGCTCAGGTGTACAATAAACTCAGGAACTCACTCCTAAGAAACCATAC<br>TCCGAAGAAAATGAAATCCCGCTGTAATTCTCCAGGAGAGTTTGAGAATAGTACACTGGGACTGATAACAAAGGGCCA<br>TAACAGACAACTCCCGCTGTAATTCTCCAGGAGAGTTTATAGTGGGCAAGTATGTAAAA<br>AATAGTCTACAAGTTCTTTCCGATCAGGCGAAGATGTTCCCAAAGTATGCTTCAGTGCTAAAGGCCTC<br>GAGTTTTTCCGGCCATCGATGCAGAGAATACTCCGATCCATTCTATAATAACCGAGTTTAAAAGGGAGACG<br>TACTCAATCGACTCGATGCAGAAACTCATTGACTTCTCACAAAGATTGTCTCACAAAATACGAGGGCTGG<br>GCTTGCTACACGTTTCGCGACTTGAAGCCACTTATAGAGATCTTCGGGCATAAAGAGAATGACTTTCCGT<br>GACGTCGCCGAAGACGGCTATAGAGTTTCAAATCCAATAAAGATCTGGAATCTGGAGCTCGCATGGA<br>GAGAAAGGTGAGTTGCATCTTTCGAAATCCAATAACCACTTACTTTCGAGTCCCTCTTTCCAACGACAACGTG<br>AAATCAAAGATTCCCAATAAACAACGGCCAGGCCGAATTTTTTACAGCCCAAAACCGAAAAGATA<br>TACAGAATTTCCCATAAAACTGAACGGCAAGAGGAATAAGGTGATAGATCACAAAGGTATTCCGAGACAAG<br>AACTGAATCAAGAAGAACAAGAAGGAAATAAGGTGATAGATCACAAAGGTATTCCGAGACAAG |

TABLE 6-continued

SEQUENCE LISTING

| SEQ ID NO: | Sequence |
|---|---|
|  | ATTTTTTTCCAGTACCTCTTACCCTGAACAGAAGAACGACTCCTTATAGATTCAATGCCCAGATAA ACAACTTTCTGCCAACAACAAAGATATCAATATTATCGGCCGTCGATAGAGGTGAGAAGCACTTGGTAT ATTATTCTGTGATCACGCAAGCATCGATATCTTGAGTCCGGTTCTTTGAACGAACTGAATGGTGTCAA CTACGCCGAGAAACTCGGTAAGAAGCTGAGAATCGGAGCAGGCTAGAAGGACTGGCAGGACGTTC AGGGTATCAAGGACCTGAAGAAGGCTACATTTCTCAGGTGGTTCGAAAACTGGCTGATTGGCCATTA AGCACAAATGCAATCATCATTTTGAACATGCGGTTTAAACAAGTCAGGGGGGATAGAGA AATCAATTTTACCACAGCTGAAAAAGCTCGATGATAAAGCTCTTTTTTGGTTGATAAGGGCGAAAA GAACCCGAGCAAGCAGGACATCTCCTTAAAGCTCTTATACCAGGCTTCCTATACATCCAGTCTGATCCAGTGACT GGGTGGAGACCCCATCTCTACCTCAGTACTTTTCTGCCAAAAAGCTAAGGACGCATTGCTAAGTTC ACAAAAATCGAGTTCGTGAACGACAGTTCGACTATGACATAAAAGATTTCAGCAGGCCAAG GAGTACCCAAACAAGACAGTTTGGAAAGTGTGTTCCAATGTGGAGAGGTTTCGTGGGACAAGAATCTG AATCAGAATAAAGGGGGATATACTTCACTACCACCAACATTACCGAGAACATCCAAGAGTTGTTCACCAAA TACGGCATCGACATTACTAAAGACTGCTGACACAGATCTCACCATCGATGAAGCAGAAGCACATCT TTCTTCCGGGATTTCATCTTTTATTTTAACTGATCTGTCAGATTAGAAATACCGACGACAGTGAGATAG CTAAAAAAAACGGGAAAGACGATTTCATTCTCCCGTGGAGCCGTTTTTGACTCCCCGCAAAGACA ATGGCAATAAGCTTCCGGAAAATAAGCCAGTATTCCGAGAAGAACGAGAATTGTGAAAAATGAAGTGGGGACCTTA TCCTCAATAAATAAGCCAGTGGATAACTTTGTGACAACAAGCCAATGCGAGACACTAG |
| SEQ ID NO: 157 | ATGGAAAAATTCAAAAACTTCTACCCATCAACAAGACCTTGAGGTTTGAGCTCCGGCCATATGGAAG ACACTGAGAACTTCAAAAGTCCGGTCTGCTGGAAAGGATGCTTTTAAGGCTAACTCTAGGAGTCT ATGCAGGCCATTATCGATGAGAAATTCAAGGAGACCATTAGAGGAGCGCTCTGAAATATACTGAGTTTTCC GAGTGACCTAGGAGAATATGACCAGTAAGGACAAAAAGATCACCGACAAGGCAGCACAAACATCGAA GAAACAGGTGATTTAAGCTTTGATGATGAGATTTCAATAACTACTTGAAGCCGGACAAAAACATCGA CGCTTCGTTCAAGAATGATCAAGCAACCCGGTCATCTCTACTTTTCAAGGCTTCACCACATACTTTGTA AATTTCTTCGAAATACGGAAACACATTCTCAAGGAGGAGTCTTCCGGTAGCATGCCTTACAGAATAATC GATGAGAACCTAACTACACATATCTAAACAATATCGAGAAGATCAAGAAATGCCTGAAGAACTGAAATCT CAGCTTGAGGGAATCGATCAAATTGACAAATTGAAGTCTGAAGTCAAATGTCAAAATCAAGGCATTAACGAA ACTCATTATAACGAATTTACTGTCAAAGAATAATTATTGGAGGGATTTGAAGTCTGAAGTCAAAATGTCAAATCAAGGCATTAACGAA TCTCTGATCGGGTCTCTAATTCTTTGCTGGATACCATTGAAATGATACCGAGTTAATTGAAATGAT CTCTGATCGATAAATAAGACAGAGATAAGTCAGGATGTTATTATGTCCGACATCCAAAATATTTTCATC AAATATAAACAACTCGGCAACTTCGACGGCAACAATATCTGCCGGGATTAGCTACTCATCATATAGTGAATGCTATCTGTTCGGATT ACGACAATAACTTTGGTGACGCAACATTAGATCTATATTCGAGAGTAGCAAGAAAATTCAACCGCCACTAACTGATG ACTAACGTGTATAGCATTACATAGTCCGAGTTACTGACAGACGACGTCTCCAGCAACATAAAG ATGCAGGCCGTACAAAAGACATTAAGCAGTCTGAGAAAACCAATCTGATGACAAGCCTTCTTGACATCCTCAAGAGC AACATCAAAGCGGTTTATGATTTGTTTGACATCGTGGATGAAGACAAAAATCCAGTTCTATACCT GGCTGTCTAAAAACGGCGAGAAATACGGACTTGAGTTTAATTCAGTGTACAACAAGAGGAACTACC TCACGAGAAAGCAGTACTCCGATAAAAAAGATTAAGTTGAACTTCGATAGTCCTACTCTCGCCAAGGGGT GGGATGCGAACAAAGAAATTGATAATAGCACAAATTATCATGAGGAAGTTCAACAACGACCGGGGCGAT TACGATTACTTCTTGGGGATCTGGGAATAAGAGCACCTGCCAACCAAAAGAATCATCCCATTAGAGGAT AATGACTGTTTGAAAAAATCGAATATAAGCTGTATCCCGATCCTAGTAAAATGCTGCCAAGCAATTC CTTTCTAAGATCTGAAAAGTAAACATCCAACTACACCCGAGTTTGATAAGAAGTACAAGAAGTCGG CACAAGAAGGGCCTGATTTTGAGAAAGAGTTCTGCACGAGTGATTGCTTTAAGCATGGATTG GTAAACCACGACGAAAAAATCAGGATGTGTTCGGGTTGAATGCGCAACACCGAAGACTACAACTCT TATACAGAGTTTCTGGAGCGTCGAAAGTGCAACTATAATCTTAGTTTCAATAAATCGCTGACACG TCTAACTTGATAAATGATGGGAAACTCTATGTTTTTCAGATCTGAGCAAGGATTTCAGCATAGATAGCA |

TABLE 6-continued

SEQUENCE LISTING

| SEQ ID NO: | Sequence |
|---|---|
| | AGGGAACAAAAAACTTGAACACAATATACTTTGAATCCCTCTTCTCGGAGGAAAATATGATCGAAGAGA<br>TGTTCAAGCTCTCAGGGGAAGCCGAAGCCGAAATTCTATCGTCCAGCAAGTTTGAATTATTGTGAAGATATTAT<br>CAAGAGGGACACCACCACGCCGAACTGAGAAGACAAATTGACTATCCCATCATCAAGGACAAGCGAT<br>ATAGCCAGGACAAATTTTTTTCGATGTCCCCATGGTTATCAACTACAAAAGCGAGAAGTTAAACTCCAA<br>ATCACTTAACACTGAAGGAACGAACGAAAATTTAGGCCAATTCACGCACATCACGTATCGACCGCGGAGA<br>GCGACATCTCATCTACCTGACCGTGGTGATGTGTCCACCGGTGAGATCGTTGAGCAAAAGCACCTGA<br>TGAAATTATAATACAGATACAAAAGGCGTCGAGCAATAACATCATTATCAATAAATTAGAAGAAGAA<br>GTCCAAGACGCGGATAATGAAAGAAAGTCCTGGGAAGCAATCGAGACGATTAAGGAGCTGAAAGAAG<br>GCTATATTAGCCACCTGATCAATGAAATCCAGAATTGCAGGAAAGTATAACGCACTGATAGTGATGG<br>AGAACCTCAATTATGGGTTTAAGACTTTAATTACATCAAAGTGGAAAAGCAGGTCTACCAGAATTCGAGA<br>CCGCCCTGATTAAAAAGTTTAATTACATCGACAAGAAGATCTCGAAACCATCCATTCATGGATACC<br>AACTGACGAATCCAATCACTACACTCGATAAAATTGGTAACCAGACGCGTATTGTGTTGTACATTCCGG<br>CTTGAATACAAGCAAGATTGATCCAGTCAGTTCGTTAACCTCCTGTATGCAGACGATTTGAAATA<br>CAAGACCCAGGAGCAGGCTAAAGCTTTATCCAGAAAATCGATAATATCTACTTCGAAAATGGTGAGTT<br>TAAATTTGATATAGATTTCGACAAATGGACAACCAACCGTACTCAATTAGCACAGACGAAATGGACACTGAC<br>AAGCTACGGAACCCGATACAGACGTTCCGAAAAATAACAAGTGGGACAGCGCCCAGT<br>ATGACCTGACCGAAGAGTTTAAATTAATCCTGAACATCGATGTTGCAGCTGCGAAACTCCGTTACTGGAACAGACAT<br>CCTATAAGAGAAATTCATGTCTTTATTCAAGCTGATGTTGCAGCTGCGAAACTCCGTTACTGGAACAGACAT<br>TGACTACATGATTAGCCCTGTGACAGATAAAACTGGAACCCACTTTGATTCACGGGAGATATCAAGAA<br>CCTGCCCGCCGATGCTGATGCGAACGGAGCTTACACATTGCTAGGAAGGGCATCATGGAAGTACATTCAGAGAA<br>TATTATGAACGGCATTAGCGACCCCTCGAAGATCAGTAATGAGAACGTACCTGAAGTACATTCAGAACCA<br>ACAAGAGTAA |
| SEQ ID NO: 158 | ATGACCCAGTTTGAGGGTTTCACCAATCTTTATCAGGTGTCAAAAACACTCAGATTTGAGCTCATCCCAC<br>AGGGTAAAACTTAAAGCATATTCAAGAGCAGGGCTTTATAGAGGAAGACAAAGCCAGAAACGACCAT<br>TATAAGGAACTAAAACCGATCATTGACCCGCAATCTACAAAAACCTATGCCGACCAATGCCTTCAGCTCGTC<br>CAACTCGATTGGGAGAATCTGAGCGCCGCTATTGGAGGAACCGAGCAGGAAGGACCGAGGAGCTAG<br>AAACGCCCTGACTGGAGCAGGCGACCTATAGAAACGCTATTCACGATTATTTATCGGCCGACCGA<br>CAATTTGACAGATGCCATCAACAAGCGGCACCTGGGACACCGTAACAACCACCGAACACGAGAATGCTCTGTTGAGGT<br>CAATGGAAAGTACTGAAACAGCTGAAGGACAGCTGGGACACCGTAACAACCACCGAACACGAGAATGCTCTGTTGAGGT<br>CCTTCGACAAGTTTACTACCTACTTTAGCGGCTTCTGACAAGCAGCCTTCTGAAAACCGTGTTTTCCGGGAGGA<br>TATTCAACAGCATTCCTCATAGGATCGTCAGGATAATTTCCCAAGTTAAGGAGAACTGCCATATC<br>TTTACCAGACTTATCACTGCTGTGCCAAGTTTACGGAGAACACTTCGAGAATGTTAAGAAGGCTATAGGC<br>ATATTCGTTTTCCACCTCCATCGAAGAAGTATTCAGTTTTCCATTCTACAATCAGTTACTCACGCAGACCC<br>AGATAGATCTCTACAATCAGCTCTGAGCGCCATTTCTAGAGAAGCAGGCACGGAAAAGATCAAGGGCT<br>TAAATGAAGTACTCAATCTTGCAATTCAGAAGACGATGAACAGCACACATTATTGCATCTCTCCCTCA<br>CAGATTCATTCCCGTTCAAACAGATCCCAGAGCTTCTGTAAGTATAAGACTTTGCTCCGTAATGAAAACGTGCTT<br>AAGTCAGATGAGGAAGTGATCCAGAGCTTCTCTTTAACGAGTTGAATTCCATCGACCTGGACACCTGCTTGCACACATTTTATCAGCCATAAA<br>AGCTGGAACGATTAGCTCTCGCTTGTGCAATCAGAGAACAGCAGCACACATTATTCACAGCCCTCATGAAGAGGC<br>GCATTTCCGAGCTCACCGGAAGATCACAAAAGTGCCAAGGAGAAAAGTCAGAGGGTCCCTTAAACAT<br>GAAGACATCAACCTACAAGAGATCATCTCTGCCGCGACACGCGATTAGACCAGCCCTGCCTACAACTCTTAAAAACA<br>GGAGGAAGGAGATTTAAAGAGCCAGCTGACTCATTACTCCGGCCTGTCATATCTCCTGGACTGGTT<br>CGCCGTGGACAATCAACGAGGTGGACCCAGAATTTAGCGCAGCTGACAGGAATTAAACTGAAA<br>TGGAGCCAAGTTTGAGCTTTACAACAAGGCTCGGAACTATGCCACTAAAAGCCCTACAGCGTGGAA<br>AGTTCAAGCTATACTGTCGTCAAAAATGTCTCTACTACCGGATGTTAATAGGAAAAAGAATAATG<br>GGGCTATACTGTCGTCAAAAATGTCTCTACTACCGGATGTTAATAGGAAAAAGAATAATG<br>AAGCCCTTCGTTTGAGCCGACCGAAAAAACCAGGAGAAGCTTTGATAAGATGTATTACGACTATTTCCC |

TABLE 6-continued

SEQUENCE LISTING

| SEQ ID NO: | Sequence |
|---|---|
|  | AGATGCAGCCAAGATGATCCCAAAATGTAGCACTCAGTTGAAGGCGGTAACCGCTCACTTTCAGACACA<br>CACCACTCCTATCTTGCTCTCCAACAACTTTATTGAGCCGCTGAAGATCACGAAGGAAATCTACGACCTT<br>AACAACCCAGAAGAACCCAAGAAATTCAAACAGCTTATGCTAAGAAGACTGGGGATCAAAAGGG<br>CTATCGAGAGGCTTTGTGTAAGTGGATTGACTTTACACGGGATTTCCTGAGTAAGTATACCAAGACCACA<br>TCTATTGACCTGTCCTCACTGAGACCTTCCTCACAATATAAGGATCTCGGAGAGTATTATGACGAACTCA<br>ACCCTCTACTTCTATCACATCTCTTTCCAGAGGATCGCGAAAAGGAAATTATGACGCCGTCGAGACAG<br>GCAAGCTGTACCTCTTCCAGATTTACAACAAGGATTTCGCAAAGGGCTACCACGAAAACCAATTGC<br>ACACTTTGTACTGGACAGGGCTCTTTCTCTCCGAAAATTTGGCCAAAACTTCAATAAAACTGAACGGGC<br>AAGCCGAGCTGTTCTTTATCGGCCCAAGTCACGTATGAAGCGGATGCCACCGGCTGGGCGAGAAGATGC<br>TCAACAAGAAACTGAAGATCAGAAGACGCCATACCAGACACTCTTTACCAAGAGCTGTATGACTACG<br>TGAATCACAGACTGAGTCACGACCTGTGATGAAGCCCGGCTCTTCTTCCAAATGTGATTACCAAAG<br>AAGTTTCCCACGAAATTATCAAGACCGGCGCTTCACCTCTGACAAATTCTTTTTCCACGTCCCAATCAC<br>CCTCAACTACCAGGCAGCCAATTCCCCTTCAAAGTTTAACCAGCGTGTGAATGCCTACCTGAAAGAGCA<br>TCCGGAGACACCCCATCATAGGGATAGACAGGAGCGGAATCTTATCTACCATTACTGTGATTGACAG<br>CACAGGTAAGATCTTGGAGCAGAGATCTTTAAATACAATCGACAGTTTGACTACCAGAAGAAACTGAA<br>TAACCGAGAAGGAAAGGGTGTGCAAGACAGGCCTGGTCAGTGGTCGGCACCATCAAGACCTGA<br>AGCAGGGCTACTTATCCCAAGTAATTCACGAATGTCGATCTTATGATTCATTATCAAGCCGTTGTTGT<br>GCTGGAGAACCTGAATTTTGGCTTCAAAAGCAAACAAGGTATCGCCGAGAAAAGCCGTGTATCAGCA<br>GTTCGAAAAGATGCTCATAGACAAGCTGACTGCTTAGTGCTTAGGATAATATCTGCTGAGAAGGTCGG<br>CGGCGTACTTAACCCATACCAGCTGACCGATCAGTTCACTAGTTTCGCCAAGATGGGAACGCAAAGTGG<br>CTTCCTTTTCTACGTGCCCGCTCCCTACACGAGTAAGATCGACCCCTCGACCGGCTTCGTCGACCCATTCG<br>TCTGGAAGACCATCAAGAATCACCAATGATCTTAGAGGGGTTGACTTCCTGCACTACG<br>ACTGAAGAGACAGGGACTTCATCTTACCACTTTAAGATGAATCGAAACCTCTCCTTCCAGCGGCCTGC<br>CTGGTTTCATGCCCCGCCATGGAAGCGGATTGTCCCAGTCATCCGAAAAACGAGACACAGTTGACGTTGCACCGGAAGTGTTGACGCGTAAGGAACCC<br>CCTTTATTGCGGGAAGCGGATTCATCGCGCTGCTGGAGGAGAGGTATTGTTTAGGGATGGATCAACA<br>TGTACCCGGCCAAGCAGCTCATCGCCGATGATTCGCACGGGATTGAATACCATGGTTGCACTGATTAGATCCGT<br>ACTGCAGATGAGGAATAGCAATGCTGCAACCACCTCAAGAATGGCCAATGAGCCAATGATGCAGACGCTAACGGGCGTA<br>TGGTGTCTGTTTTGCACTCGCGCTTTCAGAATCCGAATCCTGAACCACCTCAAGAGAGCAAAGATCTGAAGCTGCAGAA<br>CCCACATTGCTCTGAAAGGCCAGCTACTCCTGAACTATACATACAAGAACTGCCAATTAA<br>CGGCATTTCCAACCAAGACTGGCTCGCCTACATACAAGAACTGCCAATTAA |
| SEQ ID NO: 159 | ATGGCTGTCAAATCCATCAAGGTTAAATTACGGCTTGATGACATGCCCGAGATCCCGCGCCGGGCTCTGG<br>AAACTCCATAAAGGAGTGAATGCTGGCGTTAGATACTACACAGAATGGCTCTCCCTGCTGCCCAGGAA<br>AATTTGTACCGCCGGTCACCTAATGGAGATGGAGACCAGGAATGCGATAAAACAGCAAGAGTGCAA<br>AGCCGAATTGCTGGACGACTCGACCAGGTTGAGAATGACACCGAGGTCGGCGGATCGG<br>ACGACCAGCTGCTCCAGCTCGCCAGACAATTATATGAACTGCTCGTGCCCAGGCTATTGGGCAAAGG<br>GTGACGCACAGCAGATTGCTAGAAAATTTCTGTCTCCGCCGACAAAGACGCTGTGGCGGCCTTG<br>GGATAGCCAAAGCCAAACCGGCAACAAACCCGATGGGTCGCCATGAGGAGGGTGGTGACGTACTCCGAGCATTGGC<br>GAAGAAAAGGAAAAGGCCAAAGAAAGTCCGCCAGCAAGGACCCGGACGTACTCCCGAGCATTGGC<br>CGATTTTGGGCTGAAGCCAGGCAGTGCCGAGATGTGGGACTGGGACGTGAAATGTCTAGCGTGGAGTGGAAGCC<br>ATTACGCAAAGGGCAGCAGTGCGGACGTGGGACCGTGACATGTTCCAGCAAGCCATCGAGCGAATGA<br>TTTGAGCAAAAAATTTTGTAGGTCAGGAGATGGGCAGGAGTATGCCAAGCTGGTCGAGCAGAAAACCGG<br>AAGGAGCTTCGCCTGGATTAGAGAGCAAAATGGGGAAAACGAGCACTGCCACACTATGTAACCGAAGACACTGAG<br>GGGCAGTGACAAAGTGTTCAGCGGCGACAAAACCGGAAAATGGCTCCCCATGCCCCTTTGACCTGTACGACGC<br>AGAATAAAAAACGTCAGCGGCGGAACACCAAGGACGCATCATTCTCACTAGGTACGCGGTCTATAACTC<br>AGAGCCGAATATCAGGCTCTTTGGCCAGAAGACGCATCATTCCACTTCAGCCGTCTATAACTC<br>CATTTTGAGCAAATTGAACCACGCAAAAATGTTTTGCCACCTTCACGTTGCCTGACGCCACCGCTCATCCC |

TABLE 6-continued

SEQUENCE LISTING

| SEQ ID NO: | Sequence |
|---|---|
| | ATTTGGACACGGTTTGATAAGCTGGGCGGCAATCTGCAGGTATACATTCCTGTTTAACGAGTTTGGAG<br>AGCGAAGACATGCGATACGATTCCACAAGCTACTTACGAAGGTCGAAAATGCCTGGCACGTGAGGTTGGAC<br>GATGTCACCCTGCCCATCAGCATGAGCGAACAGCTGGATAATTTGTTGCCGGGACTGAAATGAACCT<br>ATAGCCCTTTATTTTAGGGACTACGGGCGGAGCAACATTTCACTGGGACGTTTTGGCGGCGCAAAAATT<br>CAGTGCCGACGCGACCAGCTCGCCCACATGCAGAGTGGAGGGGAGCAGACCACCTTACGCAGTATTCAG<br>TCTGTGAGGTGCAGTCCCAGTCAGGAGCAGTCGTTTGTACACTTTGATAAACTTTCTGACTACCTGCGAACACCCG<br>GCTGTAGGCGATAACCACCGGCCTTTGTACACTTTGATAAACTTTCTGACTACCTGCGAACACCCG<br>GATGACGGCAAATTAGGATCGGAGGGGCTGCTTAGCGCCCTGCCTGTGATGAGCGTGATCTGGGCTA<br>CGGACCTCTGCTTCCATCTCTGTGTTCCGTGTGGCCCGAAAGGACGAGTTGAACCTAATTCGAAGGGCC<br>GTGTACCATTCTTTTTCCCTATTAAGGGAAATGATAATCTCGTGCGGGTGCACGAGCGTTCCCAACTGCT<br>GAAACTGCCTGGCGAGACCTCAAAGATCTCGGAGGACAATCCGGAGCAGTCAGAACAACGTACACTTA<br>GGCAACTCCCACCCAGCTGCCTATCTGCCTTCTGTGCGGTGCGCGCTCCGAGGATCGTAGGGAGAA<br>GAGAGCGAAGCGTTTGAAAATGACTGATAGAGCCAACAGTTGACGCGCGAATCAATGACCCCGACTGG<br>CGCGAAGCCGTATACGAGCTGTCTTGCGCAGACATGGGAGCATGGGATTTGCTCAGATAAGGAGTGG<br>ATGGACCGCCGTATACGAGCGTTGCCGGTACGACATGGGAGGCAGTGGAGAGATTGGAG<br>AAAGGAGCGTTCGCTCGGGAACGCCGAAAATTCGGGATACGCAAAGGATGTCTGTGGGCGGCAATA<br>GCAATTGAGCAGATGAGTACCTGGAAGGCCGAAAAGGGATCTCGCTTTGCTATCACATTGAGGGAACACATTGATCA<br>AAGCCGACAAGTTATCAGAGCCGAAAAGGGATCTCGCTTTGCTATCACATTGAGGGAACACATTGATCA<br>CGCCAAAGAACACAGGTTGAAAAAGTTGGCTGATCGCATTATCATCGGAAGCACTCGGTTACGTCTACGC<br>CCTTGATGAGCGCGGTAAAGGAAGTGGGTAGCCAAGTATCCCCATGTCAGCTGATCCTCTGCTCGAGA<br>ACTTTCTGAGTATCAGTTCAATAACGACCGTCTCCCTCCCCGAAAATAATCAGCTCATGCAATGTCCCAC<br>GGGGTGTGTTCCAAGAACTGATCAATCAGGCTGCACGACCATCAGGTCGTAGGCACTATGTATGCA<br>GCCTTTAGCTCCCCGTTTGAAAAAGTTGGCTGGCAGCGCGATGATCGTAGGCGAGTTCCCGCACGGT<br>GCACTCAAGAACATAACCCGGAGCCTTTCCCATGTGGCTCAATAGTTGTTGTGGAGCATACCCTCGA<br>CGCTTGCCCATTGAGGGCCGATGACTTGATTCCACAGGCGAGGGGAGATCTTCTGAGCCCATTTCT<br>GCCGAAGAAGGGGATTTCCACCAAATACATGCCGACTTGAATGCTGCCAAAATCGCAGCAAGGCTG<br>TGGTCAGACTTCGACATCTCGACAATCAGACTCGGTGGGCGAAGTTAGGGCGGCAGCTGGTG<br>CTGATACCTTCAGACTGACGGGTAAGCTACCGCGTATAGCTACGATAGTAATAAGGTTTTTATACGATACG<br>GGGGTGACATATTACGAGCGTGAGAGAGGCAAGAGCGTCGGAAGGTGTTCCGCCAGAGAAGCTGAG<br>CGAAGAGGAGGCGAGCTACTGGTAGAGGCAGATGAGGCAAGAGAAAGTCCGTCGTCTGATCGGG<br>ATCCTAGCCGGGATTATTAACAGAGGTAATTGGACACGCGGTAATTCTGAGCATGGTGAATCAAA<br>GAATCAGGGTTACCTGGTGAAGCAAATTCGAAGCGGGTGCCCCCTTCAAGACAGCGCATGTGAAACA<br>CTGGGGACATCTAG |
| SEQ ID NO: 160 | ATGGCTACTCGGTCCTTCATCCTGAAAATCGAGCCAAATGAAGAGGCTGAAAAAGGGCCTCGTGGAAGACC<br>CATGAGTACTTAACCACCGGCATAGCATCTATATAGAATATCCTAAAACTATACGGCAGGAGGCTATC<br>TACGAGCATCACGACCAAGATCCTAAAAATCCAAAGAAGGTTAGTTAAGGCTGAAATCCAGGCTGAATT<br>GTGGGACTTCGTCGTGAAGATGCAGAAATGCAACAGTTTCACGCATGAAGTTGATAAGGACGTCGTGTT<br>TAATATCTCCGGAGCTGTACGAAGAACTGGTACACAGTGTGTGGAAAAGAAAGGAGAGGCCAACC<br>AGCTAAGTAATAAGTTCCTCTATCCTCTGTGACCAAGCTCTGTGAAGAGACCGCAAAGGTACCGCATCTTC<br>TGGGAGGAAACCACCGTGAAAAAGAAGACCCCGTGGCCAAATCTTAGGCAAGCTCGCCGAGTACGGTCTG<br>AATGGAAGAGGAATAAAAGAAATGCATGGCCTCGTCGAAGGAGATTAAGTGATGGAAAAG<br>AGCCCCAATCAGAGTGTGCCGAGGCTGGAAGAACATGTTTTATTCAGGGAGGAGCCCTTCCTTAGC<br>TGGGAAAGCTGGAACCTGAAGGTTAAGGAAGAGTACGAAAAAGTGAGAGGAGCATAAGACGGCAGGAAC<br>GGAGCGCATCAAAGAAGACATCCAGGCCTTTAAGCTTCTAGAACAGTATGAGAGAGAACGGCAGGAAC<br>AGCTGCTCGTCGATCACTGAACACAAAATATCGCCTGAGCAAGAAGCCGTCTGAAAAATAAGCGCTGAAT<br>GAAATCATTCAAAAGTGGCTCAAATGATGAAAATGACCCTGAAAAAATACCTTGAAGTTTTCAAG<br>GACTACCAGCCGAAGCACCCTAGAAGCCGGACTATAGTGTTTACGAATTCTTGAGCAAGAAGGA |

TABLE 6-continued

SEQUENCE LISTING

| SEQ ID NO: | Sequence |
|---|---|
|  | GAATCATTTTATATGGAGGAATCACCCGGAGTACCCATATCTGTACGCAACCTTCTGCGAAATGACAA<br>GAAAAAAAGACGCCAAGCAACAGGCTACATTTACTCTGGCCGACCCTATCAATCACCCTCTATGGGT<br>CCGGTTTGAGGAGCGCCTCCGGAAGCAATCTGAATAAATATCGTATTCTGACTGAACAGTTACACAGA<br>GAAGCTCAAGAAGAAGAAACTTACGGTCGAGCTGGACCGCCTGGAATATACCCAACAGAGTCCGAGGATGGG<br>AAGAGAAAGGAAAGGTTGACATCGTACTGCTTCCATCTGCTCAGTTTACAACCAGATATTCCTGGACAT<br>CGAGGAGAAGGGGAAACACGCCTTCACATACAAGGACGAGTCCATAAAGTTCCACTGAAGGGTACTTT<br>AGCCGGTGCTAGGGTGCAGTTGACGATCACCTGGACTGTACCCCACAAGGTGGAGAGCGGGA<br>ACGTGGGACCGAATCTACTTTAATATGACAGTGAACATTGAACCCACAGAGAGTCCAGTTAGTAAATCC<br>TGAAAATTCACCGTGACGACTTTCCGAAATTTGTGAATTTCAACCAAAGGAGCTTACGAGTGGATCA<br>AGGATTCAAAGGGAAAGAAGCTGAAATCTGGTATCGAATCTCTCGAGATCTGGTTCCGTGTCATGAGCA<br>TCGATCTGGGACAGCGCCAGCCAGTATATTCCAAGCTGGTAGAACAAAGCCTGACATCG<br>AGGGAAAGCTCTTCTTCCCAATCAAAGGCACAGAGCTGTATGCGGTGCACCGGGCGTCCTTAATATAA<br>AGCTGCCCGGTGAAACCCTGGTGAAGTCACGGAGGTGCTTAGAAAAGCGCGAGGATAACTTCAAA<br>CTGATGAACCAAAAACTGAACTTTCTGAGGAGTCCTGCACTTTCAGCAGTTCGAAGATATTACCGAA<br>CGCGAAAGAGAGTAACCAAGTGGATATCTCGTCAAGAGAACGAGCAGTCCCGTTAGTCTATCAGGAC<br>GAACTCATCCAAATACGGAGGTTGATGTATAAGCCCTACAAGGATTGGGTCGCCTTTCTTAAGCAGCTTC<br>ACAAAACGCTAGAGGTCGAAATAGGTAAGAGAGTGAAACATTGGCGGAAGTCGCTCAGCGACGGAGG<br>AAGGGACTTTATGGCATCTCTTTGAAGAACATTGACGAAATCGATAGAACCAGAGAACCAGAAAATTTTGTTGAGA<br>TGGTCCCTCCGACACCCGAGCCTGGAGATGGAGGCGGTTAGAACCAGACAGAGGTTCGCTATCGAT<br>CAGCTGAATCACCTCAATGCTCTGAAGGAGGACCGCCTCAAGAAAATGGCCAATACAATCATAATGCAC<br>GCCCTTGGCTACTGCTACGACGTCCGAAAGAAGAAGTGCCAGGCCAAGAATCCCGCCTGTCAATTATC<br>CTTTTTGAGGATCTTAGCATTACAACCCCATGGAGAACTGGCCCTTCCAGGGGAGAATTCGAAATAGTAAGCTCATG<br>AAGTGGAGCGCCGAAATCGTACCGGAGACCCCAGCGAGAAGTCTCTTTCCATCGATAAGTGATGGCCGCTGAGTG<br>CGAGGTCGGGGCCCAATTCTCCTCCGCGCTTTCATGCGAAAACTGGTTTTTAAAACTTACAGCGGAGGAAGGCTGACCC<br>GGTGACAAAGGAGAAGTTGCAAGACAATCGGTTTTTAAAGATTCCAGCAACTTGAAATGTCAAGGGAAAGTTCATTAGCT<br>TGGATAAGATAGCCGTACTTAAGGAAGGAGATCTGTACCCTGACAAAGGCGGTGAAAACCTGCAGAAGAGA<br>TTTTGGACTGCGCAAAACTTGTGACCACCCGGATTCTACAAAGTTTACTGCAAAGTATATCAAGTAGACGGACACCGTA<br>TACATCCCCGAGTCCAAAGATCAGAAGCAGAAAATTATTGAAGAGTTTGGGGAGAGGGCAGCTCTAAACAGTCC<br>AAGGATGGGTGCTACGAAGATGGGGCAACGCTGGTAAACTGGTAAATTAAGAGGGGCAGCTCTAAACAGTCC<br>TCCAGCGAGTTAGTTGATTCTGATATTCTGAAAGACGTCTTTCCATCCGATAAGTGATGGCCGCTGAGTG<br>AAATAATGCTGTACCGGAGACCCCAGCGAGAAGTCTCTTTCCATCCGATAAGTGATGGCCGCTGAGTG<br>TTCTTTGCAAGTTAGAGAGGATTCTCATAAGTAAGCTGACCAACCAATACTCAATCTCCACAATCGAG<br>GATGACTCATCCAAGCAGTCTATGTGA |
| SEQ ID NO: 161 | ATGCCTACACGCACTATCAACCTGAAACTGGTTCTTGGCAAGAATCCAGAGAATGCTACCCTTCGTCGG<br>GCACTATTTTCAACCGACCTATAGGACGTGGAATCAGGCTACCCAAACGATTGAAGAGTTCCTTCGCTTTGTC<br>GGGGGAAGCATATAGGACGGTGGATAATGAGGGGAAAGAGGCTGAAATTCCGAGACACGCCGTGCAG<br>GAGGAAGCTCTTGCGTTTGCAAAGCCGCTCAACGGCCACAATGGTTGCATCTCTACTTATGAAGACCAG<br>GAAATCCTGATGTGTCCGCAACTGTATGAAGCCGGTTGTCGCTTCTGTGAATGAAAATAATGAAGCA<br>GGGGACGCGCTCAAGCCGCTCAAAACGCGTGGGTGTCGCCACTGATGTCCGCCGAGTCCCGAGGAGGGGGGCTCAG<br>CGTTTACGACCAAGGTGCTGACCCACCCCCAGTGTGGATGAAAATCAAAGAGAAAAAAGCTCCGGGCTG<br>CCGCCGGTGATTAAGGAAACTGGATCCAGCTCCGACCAAGGGACGATTTTGTTAGCGACCAGAAAAG<br>AAGCAGGAGCAGCTGACAAAGGGAATGCGCCACTGACTCAAAACAATTAAAGGAAATGGCTTATTGCC<br>TCTTGTGAATCCCTTTTTTAGACATCTGCTTGACCCGGAGGAAGGGGTGTCACCTTGGGACAGACTC<br>GCTGTTAGGGCCGTCTTGCGTGTCGCTCATTTCATATCATGGGAATCATGAACCATCGGACACGGCCGAATAC<br>AATAGTTTGAAGCTGCGGAGGATGAGTTCGAAGCAGCTTCGAAGGACCGGAATTCAAGGACGACTTCACGCTG<br>CTTCGGCAGTAGCGAGCTAAGAGCGGCACTTCCACACTGAAGAGTATAGCTTTAGCCGATGATTCAACCCT |

TABLE 6-continued

SEQUENCE LISTING

| SEQ ID NO: | Sequence |
|---|---|
| | TATAGGATCGGCGTACGCTCCCTCCGCGTTGAACCGCGTCCCGGAGGAGTGATGATCGACAAGGAGCG |
| | ACCGAGGAGCAGCGGGTCACCATTCTCAGCAAGTTGCAGACCCAACTAAGGGGCAAATTTGGAGATCCT |
| | GACTTGTTCAACTGGCTGGCGCAGAGACCGCACGTGCCACCTCTGAGCCCTAGAGATAGTGTTACCCA |
| | CTGGTTAGGATCAACGCTGTTGACAAAGTATTGCGACGGAGAAAACCGTACGCCTTGATGACTTTTGCC |
| | CACCCAAGATTCCACCCTCGGTGGATACTTTACGAAGCCCAGGGGGCAGCAATCTCCGCCAGTATGCA |
| | CTGGATTGTACCGAAATGCTCTGCACATTTACACTGCCTCTGCTTGGTTGACGATGCACATGGCACATGGA |
| | TTGAGAAAAAATTAGGGTTCTCCTTCTTGCCCAGCGCCCAGATTCAGGACCTGACACTAGAAAAGCTCG |
| | AGAAGAAGAAAAATCGTCTCTACTACCGTTCTGGGTTCCAGCAGTTTGCCGGCCTGGCCGGAGTGCCG |
| | AGGTGCTTTTCCATCGACCATACATGGAGCACGATGAGCGAACCCAGGCCTCAACCCAGTGTTATTAGAACGCCTG |
| | GTGCTGTTTGGTTCAAACTCACCTTGGACGTGGCAACCCAGGCCCTCCAGTAACAAGTCTAAGCACACAC |
| | GCCGCGTCCGAACGCCCCCCGAGGTTCACCACTTCAGACCAGCCCTCAGTAACAAGTCTAAGCACACAC |
| | GGACCCTCCAGCCCGACTCAGAGTGTTATCCGTCGACTGGAATGCGCACCTTCGCCTCTTGCTCCGT |
| | ATTTGAGCTGATCGAGGGCAAACCAGAGACTGGCAGAAGATCCTTTAAACTCCGTGTGCCGACGAACGTTCATGGA |
| | TTCACCAAACAAGCTGTGGGCACTGAGGTTCAAGCACAGATGGCGCAAGAACGACCAGGCCTACTCCACGTG |
| | CAGAGGCGTGCCCTGCTAAACACATCAGCGATTGGCGCAAGAGAACCAGGCCTCAGCCTACTCCACGTG |
| | AGATGTGGTACAAGACACGCTCTTATCACGCGGAAAGTCAATCTGGATGCTGGAATACCTCGACGCTG |
| | TGAGGAAAACTGCTCTTATCCTGAGCCTCAGAGGCCTCCTTCACCACATTACTCAACGAGGATGAATAAGA |
| | CAAGTTCGGAGCTTAGCCAGCCGGCTCCGGCTCTGCCAGCGGCTCCCCGCCTAGGCCTACTCCACGTG |
| | CCGAGCCGACTCGATCGTGCCAGCAGCCCGAGGTACATCAGGGAAGACCTTGCCCGTTATAGATTTCGCGTTGATAGACC |
| | AGCGATATGAACTGCTTCAGCTGATCTTGTTGAGACCCACCACAGAGCGATCGTGGCTGAGACCATGCCAGGC |
| | TCGCCGTGAGAATTCTCAGCTGGAGAACACCCGCCAGGGGTTCAGTTCTGGTTTCATGCTGCCACCGG |
| | CGAGCTGTATGGACAGATCGTGGAGAACACCCGCCAGGGGTTCAGTTCTGGTTTCATGCTGCCACCGG |
| | AGCTCCCGGGTCCGGTGCCGGCTTCCTTCTTAGACGCTGATTTGACAATGACCTCCCAAAGCCTATCTG |
| | CTGAGGAACTGAGCTGGATGCTGGGGAACACAAAAGTAGAATCGGAGCACGGAGGAGAGCAGTTCGCGACACTGCATCC |
| | CTCCGAAAAGATACCTCCAGGCTCTCTGGTCTACCATGGAACGGAGGAGAGCAGTTCGCGACACTGCATCC |
| | TAAGAGACAGACGTTATGTGCAGGTTGATTCACGCCAGCTGTGATTCAGCCCCACCGGGATGATGTGCCGCGCTGCCTC |
| | TGGCCGCTGCGGCCAGCCTTCAGGCTGCGTGCATCCTCCGCGACTCAAGTGGGATATTCTTCCTTGCAACGTGTGGATTCCGG |
| | AACCCCTGGGCGTAGACTCTTGGGGCACTCTCCAGCAGCTCAGACAGTGTGAAAATGGCCAAGGCCTTTCGAACTCGT |
| | TCGGGACATGGCAGCAGCACAAGCCAGATGAACAGAGTTCGTCATGAAGACGTGTGTCCGTGCTGCCAGAGGAAGAC |
| | AACCCTTACAGGACAATAATGGCGACGACGAACTGGACGACGAACTGGAGGACGTGTTGTCCGTGCTGCCAGAGGAAGAC |
| | GACACAGGGCCCATCACTGTCTTCCGCGACTCAAGCTGGGATATTCTTCCTTGCAACGTGTGGATTCCGG |
| | CCAAACAGTTCTGGCCTGCCAGAGCCAGCCATGATTGAAGTGAAGTGAGTGGCTAGTCATTCATTGGGATGA |
| SEQ ID NO: 162 | ATGACCAAAGCTGAGGCACAGACAGACAAAAGAAGCTTACACACGACTGGGCAGGGAGCCAGGGAGCCAAGAAACGTGAGGT |
| | CCTTGGGTCAAATGAAACATTCTTCCGGGTACGCTGCAGAAGCCCTTGCTCATGCCTGTAAAGAAGGCCAGGGTAACAGAATT |
| | TAGAAAAGCATTCTCCGGTACGCTGCAGAACTAAGGGGGAAATGACCATGACGAAGAAGAACATGT |
| | TCACCCATTCTTTGCATAGTAACCTCCCAGGTTCCCTGGCCCATTTCTTGCCATTGCACACAGCGAGCTGGCCGATAAGGCTTA |
| | CCAGTTCTGCTATAAAATCTGGGAGGCAACTGCCTTCCAGGCAGCTCAAAAATCGAGGCCTATGAGTCA |
| | GTATTTTCTTCTAAATCTGGGAGGCAACTGCCTTCCAGGCAGCTCAAAAATCGAGGCCTATGAGTCA |
| | AGCTCGCTTCGGAGCTAGCCTGTCGTGCAATTTGAGTATCCAGAATTTGACGATTAGTACTCTTTTCAACGC |
| | TCTCACAACTTCAGTTCGGGCAAGCCCTGAGCCTGAGACACAGGGCCCAGAACCGGACTTGCCAGGGTCATCTC |
| | TCTCCTGACGGGCAAGCCCTGAGCCTGAGACACAGGGCCCAGAACCGGACTTGCCAGGGTCATCTC |
| | CAGAAAGATCGCTTGCTTCATGCACTAGATGCCAAGCTGTTTATCTCCAGCTTTTGATGGTGTTAATCAAG |
| | CTTCGAAGAAGATCGCCTTCATGACAGAACCGTCAACTATATGTGTTGACCCAGATGCACCCGTGTTCAG |
| | ATGAATGAATTCCAAGGTGATCGAAGAACCGTCAACTATATGTGTTGACCCAGATGCACCCGTGTTCAG |

TABLE 6-continued

SEQUENCE LISTING

| SEQ ID NO: | Sequence |
|---|---|
| | TACAACGCTGAGGATCCAGCTGATATCATCATAAAGCTGACAGTCGGTCGTCGAAGGAGGCCCGTCATC<br>AAGAATCAGAACGTGGGCATTATGTGAAAAACGGCCATTACCACCACTAACGGCCTAATGCCAATGGCTGGGGTGG<br>CTCCCAATAAAGGGCTTTCACTACTGCCAGTTTCTACTGACGATGAGCTGCTCGAATTCATTGGGGTGG<br>AGAGAAGCCATCCAGCTGTCACGCGCTGATAGAGCTGATTGCCCAGCTGAGAGCTAGAGCGCCGAACTGTTTG<br>AGAAGAATGTGTTTAGTGACACCCGTTCCGAGGTTCAGGGTATGATCGACAGTGCAGTGTCGAACCACA<br>TTGCTCGGCTGTCCAGCAGCCGAAACTCCCTGAGCATGGACAGGCGAGGAATTGGAACGCTTGATTAAAT<br>CTTTCCAGATTCATATCTCCCATTGTTCTCTGTTCAGTTCTTATCTCACCAGCTGGAGAGC<br>TTACCTGAGGCGCTCCAGTCCGAGTGAACAGCCTGATATCTTATTAGGCAGCACACAGTATATGCTG<br>ACCAACTCTCTCGTTGAAGAGTCAATTGCAACATATCAAAGGACATTAAATAGGATCAATTACCTGAGT<br>GGGGTGGCTGGGCAGATTAACGTCTATCAAAAGAAAGCAATCGACCGGCGAAAAAAATACACCTGCC<br>TGCCCCTGGAGTGAGCTCATCTCTTACCTTCATTGATTGACCAGCCGCTGATTGATGTGGAGAGCGACCTG<br>GCACACTTAAAAAACCAGTACCAGACCCTGTCCAATGAATTTGACACCCTCATTTCGGCCCTGCAGAAG<br>AACTTCGATTTGAATTTCAACAAACCACTCCTTAACCGCACGCAGCATTTCGAGGCAATGCCGGAGC<br>ACAAAAAAATGCTTATCTAAGCCCGAGATCGTGTCTACAGAGATCTTCGCTGGCGCCGACCAGT<br>TGCCTTTATCGAGGCTGCGGTCGTAGTTCTCAGAGGCGGAATGAAGTTCTGAAAAAGCACAAAATCTTT<br>GAGTCGAATAGTGAGCTGAGAGAAACTGTTGCGCCTGACCGATTCCCGCCTGACCGATTCCCGCCTGACTTCCGTGTTCCTTAGTCCATTGGAC<br>AGAAAGGCAAAAAATCTGGAGAATAAGGACAGAGAGTCCCTTTGGCTGCCGCCCTGACTGGACCTCCTT<br>GCTGGTCTGCCGACCCTGAGTTCTTCGTTTTATCAATCTCCCATAATACACGCCAAAAGGGCGATCGCC<br>GGCTGATTGACCTGATTCAGTTGACGATGAACACGATCAATCGCGATGCTTTCGTATGTTGGTGACAAGTGCTTT<br>CAAAAGCAATCTCTCGGTTGCAGTAGTCGTATACGTCCCTAAAGACAAGACAGTCTTTCGTGTTCACCCGACCCTGTCT<br>CCTTACCTGGGTAGTAAGCTCGTATACGTCCCTAAAGACAAGACAGATTGGTGGTCCATCCAGATGTTTG<br>AGGGAAGATTCGCCGATATTCGAGAGTCATGGTTCTGGAAGATGCCGGACGTCTGTGCGTGA<br>TCGACACTGCCAAACATCTCTAACATTAAAAAAAACGTGTTTAGTAGCGAAGAGTCCTTGCTTTCT<br>TCGAGAGCTGCCTCACCGGAGATATCCCGAGCTTGAAGACATTCTGAATTGTGTGCAGGTGAAGGTGAGTAG<br>CGCATTTAATAACGGGAGATATCCCGAGCTTGAAGACATTCTGAATTGTGTGCAGGTGAAGGTGAGTAG<br>GACTAATACTAGTCTCGCGAACCTGACTGCCTGTTATCAAATCTCCCATAATACACGCCAAAGGGCCATCGCC<br>CAGTTCGAAAGAGCTTACTACAAAAAGACAGATCAGATTCACGAGGACGCGACCAAGAAGAAAGATACG<br>CTTCCAGATGCCAGCAACGGAATTAGTGACACGGAATGACGCGCTGGTTGGACCCCCAGCTACCTGCT<br>GGGCATCGACCCCGTGAGTACGGAATGGGTCTCAGTTTGCGTCCAAAAAAGCAATCACCAGACCAAAGTA<br>TTCTGGATTCATCCACATTAATTCCCTGATCAATTTCGCGTCCAAAAAAGCAATCACCAGACCAAAGTA<br>GTCCCCGCCAGCAGTACAAGTCCCCGCAGAATTATCGAGCATTCAGATTCAGACGATTCAGCAGGG<br>GATATAGCTCACATTCTGATCGCTAACATCGGCTAATCAAATTGAACGCCTTGCCGTGTTCGAGGCGCTGTCTG<br>GCAACAGTCAGAGTGCTGTCATCAGGTATGGACCAAAGTTCTATCCTTCATCATGGGAGACAACG<br>ACGCACAGAACAGTATACGGAAGCAGCACTGGTTCGGTGCCTCCACACTGGGATATATTAAGGGATGCTGC<br>GCCAACCCCCAACCGAAAAAAAACCATATATAGCCTTTCCCGGAGTCAAGTGTCATCCTATG<br>GAAATAGTCAAAGGTGTAGTTGTTGCGCCCAACATCCATTGAGCAGTTGCGTGAGATGCCAAAGGACA<br>CGAGTATCAAGGAGCTGAAATCCGAAATAGTGAGATCCAACTATTCGATGGTACAATCAAGCTGTTTA<br>ACCCCGAACCTTCCAACCTTCATCGAGAGGCGGGCATAACCTAGGACCCTCACCGCATTCCTGTGCAG<br>ACCGAACTTTCAAGAATATATAGCCCTTCTGTTAGAGTTCAAGGAGCTCATTACTATCGTTTCTGAAG<br>CATCCGCCATAGCCCTCACTGAACTCAGAGGCCAATGCCGCGGGTATCCGGCCAATTGGCACACACCTGTCTGAGTACTTTTGCTTATTCT<br>GACTGCAACTCCTCACTGAAGATCACTCTCGGGAAGTTAACAGCCACCAAGTTTAACCGGACCAAGTTTCCCCTTTGTGATTGACACAT<br>CTCTTTTTTCGAACTCTGA |
| SEQ ID NO: 163 | ATGAAACGTATTCTGAACTCTCGAAAGTCGCCGACTGAGGCTGCTGTTTCGAGGAAAGGGCTCAGAG<br>CTGGTGAAGACCGTCAAGTACCCCTCTGGTTTCGCCCCTCCAGGGTGCTGTGAAGAACTCGCCGAAGCA<br>ATACGCCACGACAACCTACATTATTTGGGCAGAAGGAAATCGTAGATCTGATGGAGAAGGACCAGGG<br>CACCCAGGTCTACTCGGTGGTGACTTTTGGCTGCGACACCATGTCCTCAGGGATGTTCTTCAGTCCAAGT<br>GCTAATGCCCTTAAGATCACTCTCGGGAAGTTAACAGCGACCAAGTTTCCCCCTTTAGGAGGTTCTGG |

TABLE 6-continued

SEQUENCE LISTING

| SEQ ID NO: | Sequence |
|---|---|
| | AGCAGTCCCTTTCTTTCTCGCGGGTAGACTCAAAGTGAGCCCGCTGAACGTATCCAGCGTGAGAT |
| | CCGCAAGATCGGTAAGAGAGGTAAGAATAGAGTGGAGAACTACGCCCAGATGTAGAGACTTGTTTATCG |
| | GTCAGCTGTCTAGTGATGAAAAGCAGTCTATCGAAGCTCGTCACGATATCTGGACTCTAAGGATC |
| | ACGAAGAGACAAAGATGCTTAAGGCGGATTTCTTTGCCATTCCCCTCATCAAAGACCCAAAGCAGTGA |
| | CCGAGGAAGATCCCGAGAATGAAACCGAGCCAAACAGAGAAGCCTCTCGATTATGTGTGCTTAGTGC |
| | CCGAGTTGTACACCCGCGGTTCGTTCAATAGCCGAGACTTCCTGTCCAGCGCTGACACTATTAAGAGA |
| | CAAAATGAGCACACAGAGAAGCATGCCCTTGAGTATGTCGGCATAGAGGAGAGGGTAATG |
| | GGATGAACTCGCTGCTGGGGACGTTCCTCAAGAACCTGCAAGGAGACGTTCGAACAGATCTTCCAAT |
| | TTATGCTCGGCAGTTACGTGGGATGGCAAGGTAAGGAGAACGTCTACCGAACGGCTTGATTTGCTAG |
| | CGGAGAAGGTTAAAAGACTCGCGAAACCTAAGTTTGCCGGCAGTGGTCCGCAGTGGTCCGATGTTCCTGC |
| | ATGGTCAATTGAAGAGCTGTCCTCTAACTTTTCCGCCTGTTTAACGAGACTAGGAGCTCCTCGAAAG |
| | CATAAAATCCGACATCCAACACGCGACCATGTTAATCAGCTACGTCGAAGAGAAAGGGGATACCACCC |
| | ACAACTCTTGTCACAGTACAGGAGAAACTAGTCGAGGCGGCTAAGCTGCCAGCTCTCAGAACAAAGTGTTAGATCC |
| | AGAGATAGAAATGACTCACATGAGCGAGGCGGTAAGGTCGTAAGAATATGATCCACAAGTCGGTAGCAG |
| | GATTTCTGCCTACTCGACTCGTGTCTCGATAGGGACAAGGACAGGAGTATTCCTGTGAGTATATTTCC |
| | AAGGATCCCCAAATTGACAAAAAACTAAGGAAATCGTGCCTCGGGAGCTCCCAGGCGAGCCCCAAG |
| | AAGGATACCTGTTCACTGCCAATATCTTTTTCGCAACTTTCTGGAGAATCCTAAACATGTTCCACGTTTC |
| | ATGGCAGAAAGGATCCCGGAAGATTGGACGCGCTCGGGTCTGCCGGTCCCGTATGGTTTGACGGCATGGTG |
| | AAACAATGGCAGAAAGTGGTAAACCAGCTGGTGGAGACTCACCTGGAGCATTGTATCAGTTCAATGAAAGC |
| | TTTCCCGACAACGTTTACAGGCAATGCTGACAGTGTATAAGGAGACTCCAGAGACCTGCAGACAGAGAAATTCCTT |
| | AAGTTGTTGGCTGATGTCTGCAGGCCTCTGGTGGACTTCTTTGGGCTGAGTGTCCCCGCTGATGTGTACA |
| | AAAGTCGCCAGGACCCGGAGGAACAATGGCAAACATGTCATTCCCTTGAGTGTCCCCGCTGATGTGTACA |
| | CCGCCTGTGAGGGCGCTGGCAATCCGGCTTCGAGGACATTGGGATTTGAGTGGAAGAACCTTAAGGGCC |
| | ATGAAAGGGAGGAGACTTTCTAAGACTGGATGGAATAATCCCTGTGTTCAGGAGTACGTTGAGGCTCGTAAGGC |
| | ACTGGTGGTGAAATTGGAAGATTGGATGAATAATCCCTGTGTTCAGGAGTACGTTGAGGCTCGTAAGGC |
| | CATTGATCTCCCACTGGAAGCTCTCGGCTTTGAGTCCCCATCTTCCTGAACCGGATATCTGTTTAGTGAA |
| | CTGAGGCAGTTAGAACTGCTCTCCGCCTGAAGCGGATATCTGTTTAAGAACAACTGGC |
| | AGTCCAAACAGGCTTTTCCAGTTAGTCTACCTGCCATTAAATCCTTCCGACCCTGAGAAAAAAATTCTA |
| | ATAACTTTCAGGAACGCCTGACAGACCCCGTGACTCAAGCTCCCATGTCTAACCACCCTGGCTCTAGCAGCAAGATG |
| | CCTGTTTGGTTTCAAGCTCCCATGTAAGCTGGCACCCATGTCTAACCACCCTGGCTCTAGCAGCAAGATG |
| | GTCGTTGGCCAAACCTAAAAAAGGGGTTGCATCTAATATAGGATTCGAACCAATCCCTGATCCCGCG |
| | CACCCGTATTCCGGGTGAGATCATCATGCCAGAGCTGAAGTATCTGAGGGGTTACTGTATCTTCCAG |
| | AAGACACTCCACTGACAATAGAGCTCGCAGAGACAAGTGTTAGTTGTCAGAGCGTCAGTAGCGTGCAT |
| | TCGATCTGAAAAATCTGACTACTATCCTTGGACCGCGTCGAGGTTCCGTGTGAGTTCCGTGAAGACCAGCCTTT |
| | TAAGTTGACCCCCATCATCATCCTGACAGAAGGAGGAGTCCTTCATAGGAAAACATATCTAGGCCTTGATGC |
| | CGGGAACGCTCAGCGCTAGGGTTCGCTATCGTCACAGTCGACGGGATGGCCTCTAAAGCTTGAAGGAGCCGG |
| | GGGGGTGCATGAAGATACACAGCTGATGGCCCTACAGCAGGAGACGTATTAGAAAAATCTCAGAGATGTT |
| | TGTTCCAGCCGCTCAGAAAGGTACTTTTCGGCAGGAACGTATTAGAAAAATCTCAGAGATGTT |
| | ATTGAAACTTCTATCACGCTGTGTTCCAACTCGGAATCGCGCCAAGGTAGTACCAAGAAGAGACGTGGGCA |
| | GTTCCGGCTTGGTTGGGCAGTGGTTACGAGCATTCAGAAGGACCTCAAGAAAGCCGATGTGTTGCCAA |
| | AAAAGGAGGCAAAAACGGAGTCGATAAGAAGAACAGCAGATAGCTTTCGAAGTTAATCGCGTGCCAGATCCGCGTC |
| | GGGGCTTTAGCAAGAAGTCGGAGTGGTTCCCAACTCGGATTGTCATTCCTGATTGAAACCTTGCTGCGAGAAGTGTATGGTTCT |
| | TGCCTGAAGTGCGGATGGTGGTTCCAACTCGGATTGTCATTCCTGATTGAAACCTTGCTGCGAGAAGTGTATGGTTCT |
| | GTGCTGGATTGGAAATCGGAGTATTGTCACATTCCTGATTGAAACCTTGCTGCGAGAAGTGTATGGTTCT |
| | CCCCTCAGCAACTCGAAAAGGGGTTCAGACCCAGACATTGAAGAACGTGCACAAGACACATTGTTCGGATTTCA |
| | TGCGCCCGCCTATGTTTGACCGGAGGGTGCCCAGCAGCTGCTTACCGAGAAGGTTTGTCTTGGGACGCC |
| | GGCATGCGGGTATAGATTTGAAGAACGATTCGGACGATTGGAAGAACGATTCCGCGTATTCATTTGCCC |
| | GAGGGTTGGCTGTGGCAACTTGACCAGCGAGCAGTCAGCCGTAGTCGCTGCTCTAATCGGATA |

TABLE 6-continued

SEQUENCE LISTING

| SEQ ID NO: | Sequence |
|---|---|
| | TATTGCCGACAAAGAGGGGATGAGCGGAAAAAAGCTAGTCTACGTGCCTCTGGCAGAACTAATGCGG
AATGAAATTGAAGAAACTGGAGGAGTAGAGTTGAGGAGCAAAGCTCCGCTCAGTGA |
| SEQ ID NO: 164 | ATGGCGGAGTCGAAGCAAATGCAGTGCAGGAAGTGTGGAGCCTCTATGAAGTACGAAGTGATCGGCCT
CGGGAAGAAAAGCTGCAGTATATGTCCGACTGCAGGAATCACACATCTGAAGAAAGATTCAGA
ATAAGAAGAAAAGGACAAGAAGTATGGATGCCAGTAAAGCCAACGAATCCAGTTGCA
GGGGCCTTATCCCGATAAAAAGTTCAGACATCAAGACTTATAAAGTATCCGACCTGAATGGT
GAGGTCCATGACTCAGGGGTGCCCGAAAAAAATAGCCAAGCAATCCAAGAGGATGAAATAGGGCTCCT
CGGCCCCTCTTCCGAGTACGCCTGTTGACATCGCTAGCCAGAACAGAGCCAGCCCTACAGTGTTGTAGA
CTTTTGGTTTGACGCTGTGTGCCGGAGGCGTGTTCGCCTATTCTGGGGCTAGATTGCTGTCTACCGTCC
TGCAGCTATCTGGAGGAGGCGCATCGCCAGCCCTGGCACTCCCCTTTTGTCGACGATATCAA
TCTGGCACAGGCCGAAAAATTTCTGCGCGGTGTCCAGGCGAACCGGCCAAGATAAGCTGGGAAGCGCA
TTGAGAGTGCTTCGCAGAGGGCCCGACTTGAGGCCTCAGGCATCAAGGACCGATGCGTGAATTTGTCC
AGGCTATCGATGTCGCTCAGACCGCTGGCAGCCGTTTTGCCCCGAAACTGAAAATCTTTGGGATTTCTCA
GATGCCGAGGCAAAGCAGTGGAACAATCACCGTGTGACATCCTGCCCGACTATTACGT
CCCAGAAGAAAATCGCGCAGATCAGTTGGTCGTCCTCGTCTAAGACACTGAGAGAGTAGCATACTGTAT
GGGGATCGAAGATGAGGCCGGTTTTGAACATCTTGGAATTGATCCTGGCGCACTATCAATTTTCCAAT
CCGCAGACGCCTTACTGGGAGGGCAGGAAGGGAACTGATTGAAAGATTGGCTTGGCTGAAGCAC
CGTGCAGAGGGGCTTTATCTGAAGGAACCCATTTTGGAAATAGTTGGGCGACCATAGTCTAGAATT
TTTTCCAGAATAGCCGGGTGGCTTTCTGGGTGCGCTGGGAAGCTAAAGATCGCCAAAGACCAGATCAGC
GGAGTGCGTACTGATCGTGTTCTTCTGAAGAGATGCTGATGGCGGTCCCGCAGTCCGCCCCTTCTCCG
ACTTCATAGCCTCTATCTCGCCTTCCTGAATCGCTTCAGAATCTAGTCAGGATCCTGCCGA
ACAGTTGAGGGCCCTATACCGCTTTCATCTGAACCGCCGGGTGCGAAGCATGCCAACAAGCAGT
CCAGCGATCCGACAGCCAAGAATGCCTTATAAAGGAACAACTGACCGTGGACCACCTGAGTTTAACAA
GGCCTTTCCCTTCTTCTGATACGGAAGAAGAAAAAGAAAAGGGGCTAACTGCGCTAATGCGCTCCGTC
CGAGGAGGAGCAACGGGGCCTCGAAGACAAGAACCAGAAGAAGTTTCAGAGAATCCCCGATTCTTCGGCGAGGG
AGGAAGGCAACGGGGCCATCGACTCCACTGAAGCCCCCGCAGTACTTGCGACATGTTCTGTAACAACATGCGG
GCCATCTTATGCAATTAGAATCCCAACCGCGTAAAGCTCCCCAGGGATTTTAAGTGTTTCCTGCAGAATC
GGCTCAGAAATTGTATAAGCAGACATTCCTGAACGCTCGATCCAACAAGTGCCGGGCATTACTAGAGT
CCGTATTGATTAGTTGGGAGAGTTTTACACCTACGGGGCTAACAGAGAAAAATTCGACTGCGTCATG
AAGCTTCTGAGCGCTCCTCCGACCCAGATTACGTCGTGCAACAGGCGCTGGAGATCGCTCGGAGGCTGT
TTCTTCGGCTTTGAGTGAGGAGGACTGTAGCGCAGGTGAAAGAGTGGATCTGGTCGAAATACATAAGA
AAGCCATATCTTCCTGTTGGCCATCACTCAGGCTGAGTGTCTGTGGGCAGCTATAACTGGCTGGGCAA
TTCTACCGTGAGTCGGTACCTGTCCGTGGACTGATACCCCTTTACGGACCCAGCTGGAAGAAATTC
TTAAATGCAACCGTGTTATCTCAGATGCGGGGCTGGCTATCAGGTTATCATCTCAGGAACTGAAGAT
GGATTTGACGTACAGCTGGAGTCTAGTTGCCAGGATAAATCGCAACACTTGCTCGTGTACAGGGCTTCAC
GAGACCTTGCCGCCTGCAAGCGCTACTTGTCCAGTCAGTTGAAGAGCCTTTAGCTGGAGCTTATCT
GGGGGCCTTTATCCGTAGCCGATGATGAAATGATTGAAAGAGGATGAGCCTTTCGAGGTGTGGGAATGGACC
GAGACACAGACGCCCCATAGTTTCGGGTGGCAGATCCCGTTCGAGGTGTGCAGAGGTGGAATGGACC
AAGGAACCGCCTGGCGTTCCAGAAACCGACCGAGACGCAACCCTTCAGTTATAGCCAGACTACCTGGACGGGTTCTATC
AATACGGCCCAAGAACTGGAGTATGCGGTGCTCCACAGCCGGCTCGTCAGTGCCGGTAGAACAGCGCGTCG
CCTTGATTTGGAATCTTCCAGGCCGAAAAGTGAGCGGAACGGAGGCTCTGCCTCCAAATAGGTACCTGG
CCGTCCATTCAGTTCCGCCCCAGTGGCCCCCAGTGGCAGCGGCCGACCAGGGCAGTGCTTGTTCTGCCGCTTCAAAT
GACTCTTTCCACACAACAATGACCGTCAATGCTTCCCCAGAAACGGAGGAAGAACAAGAGGAAGCC
ACTCGAGGAGGAACAATAGCGGTATCTCCGATATTGGCGCAGTGCCAAGAGCCCAGTCCGAAGTCGAT
ATGCGGAAAACAAAGACGCGGTATCTCCGATATTGGGCGCAGTCCAAGAGCCCAGTCCGAAGTCGAT |

TABLE 6-continued

SEQUENCE LISTING

| SEQ ID NO: | Sequence |
|---|---|
| | GCGGCCAAGGAGCTCCATCGAGAGCTCCATCGAAAATACACCGATGTTGCTACTCCGCTGGGTGTCGAATTGTCGTTCAA<br>TGGGCACCCCAACCCAAACCAAGGCACTGCGCCGCCTCAGACGTGTACGCTGTACGCCGTGAGGACT<br>GAAGCACCAAGATCCGGCAATCAGGAAGATCACGCCAGGATGAAATCTTCTGGGGATACACATGGGG<br>TACGTATTGGGAAAAAGAAGCCCGAGACATCCTCGGCATTAGTACCCAGTGTATTGGACAGGCGG<br>GATCGGCGAGTCCTGCCCGGCTGTCGCCGTCGCCTATTGGGACACATCAGGGCCACCTCAACCCAGAC<br>TGAATGGGAGAAGAGGAAGTCGTGTTTGGGCGATTGAAAAAGTTCTTCCCATCCTGA |
| SEQ ID NO: 165 | ATGGAGAAGCGCATCAATAAAATTCGAAGAAGCTGTCTGCCGATAACGCCACAAAACCAGTTAGTCGA<br>AGCGGCCCATGAGAGCCTGCTAGTTCGAGTGATGACTGATGATCTGAAGAAAAGGCTGAAAAGCG<br>ACGCAAGAAGCCTGAGGTAATGCCTCAGGTTATAAGTAACAATGCAGCAAACAATCTGCGGATGCTGCT<br>TGACATTACACAAAGATGAGGAATCAGAAACGCCAATTCTCCAGGTGTATTGGCAGCAGTTCAAGGATGATCACGT<br>AGGCCTGATGTGTAAATTCGCCAACCTGCAAGCAAGAAGATCGACAAGAAGCTGAAACCCCAGA<br>TGGATGAAAAGGCAATTTAACACCGCGGAATTCGCTTGTCCCAGTGTGGGCAGCCACTGTTCGTGT<br>ACAAGTTAGACACAGTGTCGGAAAAAGGAAGGCATACACTAACTACTTTGGACGGTGCAATGTTGCA<br>GAACACGAAAAGCTGATACTGCTTGCCCAGCTTAAGCCGCAAAGACAGCGACGAAGCGGTGACCTA<br>CAGCCTGGGAAATTCGGCAGCCAGCGGGCACTGGACTTCTATTCTATTCCACCGTTACCAAGGAGAGCACCCA<br>CCCAGTGAAGCCGTTGGCCCAAATCGCTGGACCTGGAAACCGATCGACGCAGCGGACCAGTCGGCAGTCGGCCCTGTC<br>CGATGCCTGTATGGGCACAATTGCTTCTTCCTGTCCAAGTACCAAGGACATCATAATCGAGCACCAAAAA<br>GTTGTGAAAGGGAATCAGAAACGCCTGGAATCCCTTGAGAACTGGCCGGCAAGGAGAACCTTGAGTA<br>CCCGTCCGTGACCCTGCCTCCACAGCCACATACCAAAGAGGGCGTAGACGCGTATAATGAGGTCATTGC<br>CCGCCTTCGCCATGTGGGTTAATTTAACCTGTGCAGAAATTAAAACTAAGCCGAGATGATGCTAAACC<br>GTTACTGAGATTGAAGGGATTCCCGTTAGCTTTCTGGTTGGAGAGAAGGGAAAACGAGGTTGATTGGTG<br>GAATACTATTAATGAGGTGAAAAAGCTTATTGACCGTCAAGGATATGGGCAGGTGTTTCTGAGCGG<br>GGTGACTGCCAAAGAGAGAATACCATCCTGAGGGATACAATTACCTCCCAACGAGAATGATCATAA<br>GAAAAGAGAGGGGAGCTTAGAGAATCCAAAGAATCCAAAGAGGCCATTCGTGATCTCCTGCTCT<br>ACCTCGAGAAGGGCTCTCCACATTGAACGGGAAGAAGGTTTTGACGAAGCTGGGAGCGCCATTGACAAG<br>AAGATCGCCGGGCTGACTGCTGCGCGCGAAGGCCCTTCGTTGCTGCGAACTCTGAAGGAAATGATGA<br>GGCCCTGCTGACTGCCGTCGAAATACAGCTGCAGAGGGTGCGGATCTAAGGGGGAAATCCCTTCGC<br>GAAAGAGTTTTACGCCTGTGAAATACAGCTGCAGGGTAGGGTCTCCATCGGCAGTAGTGATGACATTCTATCCA<br>AGTGGAAGCCGAGATAGGGTAGTTGACATTGACATTGAGAACGGCAAGAAGAGTTCTATCTGCTGATGAACTA<br>GTATAGAAACCTGCTCGCCTGGAAGTACTTAGAGAACGCCAAGAGAGAGTTCGGAAAGTGGCAAGGCC<br>CGGGAAAAAAGTAGAATTCGCTTTACAGTGACCGAATAAAGAAGTCCGGAAAGTGGCAAGGCC<br>TCTTATACGGAGGCGGCAAAGCAAAGTGATAGACTTGACTTTTGACCCTGACGACAGCTGATAA<br>TCTTGCCGTGCTGGCCTTTGCCACAAGACAAGGTAGGGAATTTATCTGGAATGATCTTTTCTCGAGAC<br>CGGACTCATCAAGCTCGCAAAGTCGAAGGTCATCGAAGAACAATCTACAATAAAAAGATAGGCCGAG<br>ACGAGCCAGCCTGTTTGTGCTTTGACATTTGAGCGGAGAGGTCGTAGATCCCAGCAACATCAAAC<br>CCGTGAACCTGCATCGGTGTTGACAGGGCCGAGAACATCCCGGCGGTTATCGCACTGACGATCCAGAAG<br>GATGTCCTCTGCCCAGTTCAAAGATTCATCGGAGGGCAAAGAAGTGGAGCAACGACATTTGAGGATAGGAGGGGT<br>ACAAGGAGAAGCAGCGAGCTATCCAGGCGGCCAAATGGACCAACGAAGTGGAGCAACGAACAACCAT<br>CGCAAGTTCGCTTCCAAAGTCGTAACCTGGCTGGACAGATATGGTGCGCAATTCTGCCCGTGAACTTTCT<br>ACCACGCCGTTACACGACGGGTGTAGTGTTTGAAAATCTTTGAAAATGGAGGATTGGCTGACCGCCAAACTGGCGTATG<br>AGCGGACCTTTATGACGGAGAGACGTATATCAAAAATCTTGGCCCAGTATACATCTAAGACGTGCAGTAACT<br>AAGGACTCACATCCAAGACCTATCTGAGCATCCATGGCATGCTGGTCCCGTTAAAAAAGACATCTGACGCT<br>GTGGCTTCACCATTACCACAGCTGCAAAGCTCAATGGCCATCCAAAGACCAAAATTACCTATTATAACGTATAAA<br>GGGCTACTACCCCAACAATAAAGAGCTCAAAGCCGAAGACAAATTACCTATTATAACGTATAAA<br>GACAGACTGTCGAAGGAGTTGAGCGCCGAGACGAGGCGTTGTTCTTGCTGAAAAGGGGTTCTCTATCGA<br>ATCTCTAAGTGGATTAAGGACGCGCCGAGACGGGAGCAATTCTGCCCGTGAACTTTTCT<br>CCCGTGCAGGAGCAGTTCGTGTCTGGACTGCGCCACCGAGTTCATGCTGATGAGCAAGCTGCTCTA |

TABLE 6-continued

SEQUENCE LISTING

| SEQ ID NO: | Sequence |
|---|---|
| | AATATTGCCCGTAGTTGGTTGTTCCTGAACAGCAATTCAACAGAGTTCAAGTCATACAAGAGCCGAAAG<br>CAGCCGTTTGTGGGCGCATGGCAGGCATTTTACAAAAGACGCCTGAAGGAAGTGGAAGCCAAACGCC |
| SEQ ID NO: 166 | ATGAAAAGGATTAACAAAATCCGAAGGCGCTTGTGAAGGATTCTAACCACCAAAAGGCTGGCAAGAC<br>GGGGCCCATGAAAACATTACTCGTTAGAGTTATGACCCCCGACCTCAGAGAGCGACTGGAAAATTTACG<br>CAAGAAGCCAAGAGAACATTACTCAGCCATTAGTAATACCCTCGGGCAAACCTAAACAAGTTGCTTAC<br>TGAATTACACGGAGATGAAAAAGGCCATACTGCATGTGATGAAGAGGTTCAAAAGGACCCCTGTCGG<br>GCTAATGAGCAGGGTGGCTCAGCCTGCACCTAAAAACATCGACCAGCGAAACTCATCCCAGTTAAGGA<br>CGGAATGACAAGTGAGAGATTGACAAGTTCAGGTTTCGCCTGCTCACAGTGCTGTCAACCCTGTACGTTTATAAG<br>TTAGAACAAGTGAATGACACAAGGAAAAGCCTCACACAAATTATTTTGGCCGGTGTAATGTCTCTGAGCAT<br>GAGCGCTCTGATTCTGTTGTCCCCGACATAACCGGAAGCTAATGACGAGCTCGTAACCTACAGCTGGGG<br>AAGTTTGGCCAAAGACATTGGACTTCTATTCAATCCATGTGACCCCGCGAATCCAATCATCCCGTCAAGC<br>CCTTGGAGCAGATAGGGGGCAATAGTTGCGCTTCTGCCCTGTGGGCAAAGCCCTGTCCGACGCCTGTA<br>TGGGAGCCCGTGGCTTCATTCCTGACCAAATATCAGGATATCATCTTGAGCACCCAGAAAGTGATCAAGA<br>AAAATGAAAAAAGGTTAGCAACTTCAAGGATATATGCAAGCGCTAACGCTTGGCTTTCTCTAAAATCA<br>CACTTCCACCTCAGCCTCACACAAAGAAAGCATCGAGGCATACAACAATGTGGTGGCCCAGATGTCA<br>TCTGGGTTAACTTAAACCTGTGGCAGAAACTTAAAATTGGCAGGATGAGAGGCAAAACCTTACAGCGCC<br>GTAAAGGATTCCCCAGCTTCCACTGGTGAGCGCCAGGCTAACGTAAGTCTTCTGGCAGAACCTCGCCGGTT<br>GTAACGTCAAGAAGCTCATCAATGAACCTGGGAAAAGAAGACTGTAAAGTCTTCTGGCAGAACCTCGCCGGTT<br>ACAAACGGCAGGAGGCGCTGTTACCTTATCTGTCGAGTGAAGAGACCGGAAAAAAGGCAAGAAATTT<br>GCTCGTTATCAGTTTGGTGATTTGCTCCTACATTTGAAGAAGAAGCACCGGCAGGACTGTCAAAGCACCAAGCTCGAAGA<br>TACGATGAGGCTCGGAGAGGATTGACAAAAGGTGGAGGGACTGTCAAAGCACCATCAAGCTCGAAGA<br>AGAGGCCAGAGCGAGGACCGCCAAAGCACGCGCTAACCTGACTCGCTGCCGGCGAAGGCCAGTT<br>TTGTAATCGAAGGCCTTAAAGAAGCCCTTCCGAGTGAAGCTTCCAATCGAGGCCGACAAGGATGAATTCTGCAGATGCGAATTAAACTCAGAAGT<br>GGTACCGCGATCTCCGAGTGAAGCTTCCGAGTGAAGGATGAATTCTGCAGATGCGAATTAAACTCAGAAGT<br>TCAGTAAACAGTATATTGCTCTTTATAGGCAAGGACGAAAAATCCAACCTGTACCTTAT<br>TATTAATTATTCAAAGGGACTAAATCGAGATTTAAGAACTGAGATATAAAGCCTGAAGCCTTTGAGGCGAACCG<br>ATTCCAATCGATTATATTGCCACTAGCTTTTGCCAAGCGCGCAGGGAGAGTGATTGAAAAGACATTGTACAATCGGAACGATTTGC<br>CCCAATCGATTATTATTGCCACTAGCTTTTGCCAAGCGCGCAGGGAGAGTGATTGAAAAGACATTGTACAATCGGA<br>TTTCACTGGAAACAGGGTCCCTTAAGCTGCAACTGAACCTGCCCTTTCGTGGCTCTGACATTCGAGCCAGGGAGGTTCTGGACTCTA<br>GGACACGTCAGGATGAACCTGCCCTTTCGTGGCTCTGACATTCGAGCCAGGGAGGTTCTGGACTCTA<br>GCAATATCAAGCCAATGAACCTGATCGCTATAGACCGAGGAGAGATATTCCGGCTGTGATCGCACTCA<br>CCGATCCCGAAGGATGTCCCTTTTCGTCCCAAGGACTCCTTAGGCAATCCAACTCATATCCCTGAGAAT<br>CGGCAGTCATACAAGGAGAAGCAGCAGCGAACAATTCAGGCCGCCAAGGAGTCGAGCAGAGGCGAGCTG<br>GCGCTACAGCCCGTAAATACGCTAGTAAAGCTAGTAAAGCTGCCACGATATGGCTGCGCAATACTGCTA<br>GAGACCGTCGTACTATGCAGTGACGCAGACGCAATGCTGATATTCGAGAATCTGTCCAGAGGATTCG<br>GAAGGCAGGGCAAGCGGACGTTCATGGCCCAGCGCCAGTATACAAGGATGGAGATTGGTTAACGCC<br>AAGTTGCCTATGAGGGGCTACCTAGTAACTCACTTCTGCTAGTCGTCTAAGACGCTGGCTCAATACCAGTAAG<br>ACCTGCCACCGGCTGATGACTATTAATGAGGAACTGAAAGTGGAAGGACAGATTACCTATTAT<br>AATCGCTACAAGCGTCAAAACGTCGTCCAAGGACCTGTCGGTTGGAATTGGACACTCAGTGAAGAGTCC<br>GTGAACAATGATATCGGCCGGTCCAGGAGAAATTTGTCTGCAGGATTCGAGACACGCCGCACGA<br>GCAGGCAGCTGAACATTGCCAGATCCTGCCAGATCCTGGCTGTTCCTTAGGTCCAGAATATAAGAAGTACCAGAC<br>TAACAAACCACCGGAAAACACAGATAAAAGGGCCCTTTGTCGAAACTTGGCAATCCTTTTACCGAAGAA<br>GTTAAGGAAGTGTGGAAGCCC |
| SEQ ID NO: 167 | ATGGATAAGAAATACTCAATAGGCTTAGCACGGCTTAGCAATCGGCACAATAGCCTCGATGCGCGTGATCACTGAT<br>GAATATAAGGTTCCCTCTAAAAAGTTCAAGGTTCTGGGAAATACAGACCCCCACAGTATCAAAAAAAT |

TABLE 6-continued

SEQUENCE LISTING

| SEQ ID NO: | Sequence |
|---|---|
| | CTTATAGGGCTCTCTTTTATTTGACAGTGAGAGACAGCCGAAGCGACTCGTCTCAAACGACAGCTCGT
AGAAGGTATACACGTCCGAAGAGAATCGTATTTGTTATCTACAGGAGATTTTTCAAATGATGCGAAA
GTAGATGATAGTTTCTTTCATCGACTTGAAGAGTCTTTTTGGTGAAGAAGACAAGAAGCATGAACGTC
ATCCTATTTTTGGAAATATAGTAGATGAAGTTGCTTATCATGAGAAATATCCAACTATCTATCATCTGCG
AAAAAATTGGTAGATTCTACTGATAAAGCGGATTTGCCTTAATCTATTTGGCCTTAGCGACATATGATT
AAGTTTCGTGGTCATTTTTTGATTGAGGAGATTAAATCCTGATAATAGTGATGTGGACAAACTATTTA
TCCAGTTGGTACAAACCTCACATCAATTATTTGAAGAAACCTTATTAACGACGAATGGGATAGATGCTA
AAGCCGATTCTTTCTGCCACGATTGAGTAAATCAAGACGATTAGAAAATCTCATTGCTCAGCTCCCGTGA
GAAGAAAATGGCTTATTTGGAATTCCATTGCTTTGTCATTGGGTTTGACCCCTAATTTAAATCAAAT
TTGATTTGGCAGAAGATGCTAAATTACAGCTTTCAAAAGATACTTAGCGATGATGATTTAGATATTTAT
TGGCGCAAATTGGAGATCAATATGCTAAATTTTGGCAGCTTAAGATTTATCAGATGCTATTTTACT
TTCAGATATCCTAAGAGTAAATACTGAAATAACTAAGGCTCCCCTATCAGCTTCAATGATTAAACGCTAC
GATGAACATCATCAAGACTTGACTCTTTTAAAAGCTTTAGTTGACAACAACTTCAGAAAAGTATAAA
GAAATCTTTTTTGATCAATCAAAAAACGGATATGCAGTTTATATTGATGGGGAGCTAGCCAAGAAGAA
TTTTATAAATTTATCAAACCAATTTAGAAAAATGGATGGATACTAGGAGAATTATTGGTGAAACTAAATC
GTGAAGATTTGCTGCGCAAGCAACCTTTGACAACGCTCTATTCCCCATCAAATTCACTTGGGTGA
GCTGCATGCTATTTTGAGAAGACAAGAAGACTTTTATCCATTTTTAAAAGACAATCGTGAAGAATTGA
AAAAATCTTGACTTTTCGAATTCCTTATTATGTTGGTCCATTGGCGCGTTGGCAATAGTCGTTTGCATGGA
TGACTCGGAAGTCTGAAGAAACAATTTAGAAGAAGTTCGATAAAGGTGCTTCAG
CTCAATCATTTATTGAACGCATGACTATTTACGGTATTTTTATAACGAATTTGATAAAATCTCAAACACATCG
ATAGTTTGCTTTATGAGTATTTTCAGGTGAACAAGAAAGCCATTGTTGATTTACTCTTCAAACAAATCG
GCGAAAACCAGCATTTCTTTCAGGTGAACAAGAAAGCCATTGTTGATTTACTCTTCAAACAAATCG
AAAGTAACCGTTAAGCAATTAAAAGAAGATTATTTCAAAGAAAATAGAAATGTTTTGATAGTGTTGAAAT
TTCAGGAGTTGAAGATAGATTAAATGCTTCATTAGTAGTGTACCTACCATGATATTGTTTTAACATTGACCTTATTTG
AAGATTTTTGGATAATGAAGAAATGAAGAATTCTTAGAGATGAATATGCTCACCTCTTTGATGATAAGGTGATGAAAC
AAGATAGGGAGATGATTGAGGAAGACTTAAAACATATGCTAAAACATGTCTGAAAATTGATTAATGGTATTAGGGATAA
AGCTTAAACGTCGCCGTTATACTGTTAGATTTTTGAAATCACATGGTTTTGCCAATGCAATTTTATGCAGCTG
GCAATCTGGCAAAACAATATTAGATTTTTAAAGAAGACATTCAAAAAGCACAAGTGTCTGGACAAGGCGATAGT
ATCCATGATGATAATTTGACATTTAAAGAAGAAGCATTCAAAAAGACAAGTGTCTGGACAAGGCGATAGT
TTACATGAACATATTGCAAATTTAGCTGGTGTAGCCCTGCTATTAAAAAGGTATTTTACAGACTGTAAAAG
TTGTTGATGAATGTCAAAGTAATGGGCGCGGCATAGTGGCCTATGAAACGAATCGAAGAAGGTATC
AAAATCAGACAACTCAAAAGGGCCAGAAAAATTCGCGAGCGTATGAAACGAATCGAAGAAGGTATC
AAAGAATTAGGAAGTCAGATTCTTAAAGAGACATCCTGTTGAAAATACTCAATTGCAAAATGAAAAGCTC
TATCTCTATTATCTCCAAAATGGAAGAGACATGTATGTGGACCAAGAATTAGATATTATCGTTAAGTG
ATTATGATGTCGATCACATTGTTCCACAAAGTTTCCTTAAAGACGATTCAATAGACAATAAGGTCTTAAC
GCGTTCTGATAAAAATCGTGGTAAATGGTGGTAAGCTTCCAAGTGAAGAAGTAGTCAAAAGATGAAAA
ACTATTGGAGACAACTTCTAAACGCCAAGTTAATCACTCAAGCTAAGTTTGATAATTTAACGAAAGCTG
AACGTGGAAGGTTGAGTGAACTTGATAAAGCTGATAAAGCCAATTGTTTCAAGCTAAGCTTGAAACTCGCCAAA
TCACTAAGCATGTGGCACAATTTGGATAGTCGCATGAATAACTAATACGAAATGATAAACTTA
TTCGAGAGGTTAAAGTGATTAATCCTTAAAATTAGTTTCTGACTTCCGAAAAGATTTCCAATTCTA
TAAAGTACGTGAGAAATATCCAAAATTGAATCGGAGTTGTCTATGGTGATTATAAAGTTGGAACTGCT
TTGATTAAGAAAATATCCAAAAACTTGAATCGGAGTTGTCTATGGTGATTATAAAGTTGGAACTGCT
AAATGATTGCTAAGTCGACAAGAAATAGGCAAAGCAACCGCAAAATATTCTTTTACTCTAATATCA
TGAACTTCTTCAAAACAGAATTACCCTTGCCAAATGGAGAATTCCAAATCGCCCTCTAATCGAAACTA
ATGGGAAAACTGGAGAAATTGTCTGGGAATAAAGGCGAGATACAGGCGAGTTTCTCCAAGAGTCAATTTAC
TGCCCCAAGTCAATATTGTCAAGAAACAGAAGTTACAGCCGGATTCTCCAAGGATTCTCCAAGAGTCAATTTAC
CAAAAGAAATTCGGACAAGCTTATTGCTCGTAAAAACAGCTGGGATCCAAAAAATATGTGGTTTG
ATAGTCCAACGGTAGCTTATTCAGTCCTAGTGGTTGCTAAGGTGCAAGAAGTAGTCGAAGAAGTTAA
AATCCGTTAAAGAGTTACTAGGGATCACATTATGAAAGAAGTTCCTTTGAAAAAAATCGATTGACT |

TABLE 6-continued

SEQUENCE LISTING

| SEQ ID NO: | Sequence |
|---|---|
|  | TTTTAGAAGCTAAAGGATATAAGGAAGTTAAAAAGACTTAATCATTAAACTACCTAAATATAGTCTTTT |
|  | TGAGTTAGAAAACGTCGTAAACGATGCTGGCTAGTGCCGGAGTGCCGGAGAATTACAAAAAGGAAATGAGCTGG |
|  | CCTCTGCCAAGCAAATATGTGAATTTTTATATTTAGCTAGTCATTATGAACAAAAGTTGAAGGGTAGTCCAGA |
|  | AGATAACGAACAAAAACAATTGTTTGTGAGCAGCATAAGCATTATTTAGATGAGATTATTGAGCAAAT |
|  | CAGTGAATTTTCTAAGCGTGTTATTTAGCAGATGCAATTCAATTAGAAAGTTCTTAGTGCATATAACAA |
|  | CATAGAGACAAACCAATACGTGAACAAGCAGAAAATATTATTCATTTATTTACGTTGACGAATCTTGAA |
|  | GCTCCCGCTCCTCTTTAAAATATTTGATACAACAATTGATCGTAAACGATATACGTCTAAAAGAAGTTT |
|  | TAGATGCCACTCTTATCCATCCATCCATCGTCTTTATGAAACACCGCATTGATTTGAGTCAGCTAGG |
|  | AGGTGACTGA |
| SEQ ID NO: 168 | ATGGATAAGAAGTATTCAATTGACTTGCGATTGCGATTGCACTAACAGTGTGGGCTGGCGGTGATTACAGAC |
|  | GAGTATAAGGTGCCCGTCAAAAAGTTTAAAGTTCTGGGCAACACTGATCGCCATTCCATCAAGAAAAAC |
|  | CTAATCGGGGCCCTTCTTTTTTGATAGTGGCGAAACGTCCGAGGCGACGGCTAAAACGTACCGGCGG |
|  | CGTGCCTACACCCGACGAAAAAACGTATTTGTTACCTTCAGGAGATCTTCAGTTAACGAAATGCTAAG |
|  | GTGGACGAATTCATTCTTCCACCGTCGGAGGAGTCCTTTTTAGTTGAAGAAGACAAGAAGCATGAGCGA |
|  | CACCCAATTTTTGGTAACATTGTCGACGAAGTCGCCTATCACGAAAAATATCCGACCATTTATCCTGC |
|  | GCAAAAACTGGTCGATAGCCACGGGATCTGCGACTTATTCTGCGATAATAGCGATGTAGAACAAACTGT |
|  | TCAAGTTCCCGGCCACTTCCTGATAGAAGGAGACCCTGAACCCGATAATAGCCATGTAGAACAAACTGT |
|  | TAATCAGCTGGTCCAGACCTACAACCAGCTGTTTGAAGAAAATCCGATTAATGCGTCAGGCGTGAATG |
|  | CGAAAGCGATACTGAGTGCCCGCTGTCGAATCTGCCGTCTCACTGGGCTCACGAGACCTGACCAGCTGCCG |
|  | GCGAAAAAAAACGGTCTTTTGCAGAGGATGCGAAGCTTCAACTGTCAAGCTTCAAGGACACACTGATCTGATA |
|  | ATCTTCTGGCACAAATCGGTGATCAGTATGCCGGATTATTCCTTGCAGCCGAAAACCTATCTGACGCAAT |
|  | TCTGTGAGCGATATCCCTCCGCGTCAACACCGGAAATCACTACAAAGCGCTGCGTCAGCGTCAGCTTCCCGAAAA |
|  | CGTTATGATGAGCACCATCGAGGATCTGACCTTGAAGAATCAATGTTAATGCCGGATACATTGATGGCGGCCAGTCAG |
|  | TATAAAGAGATCTTTTTGATCAATCGAAGAATGTTATGCGACAGCAGCAGATGGCGAAGAACTGCTTGTGAAA |
|  | GAAGAATTTACAAATTCATCAACACCGATCCTGCAACACGTACGTTGCAAACAATCTCATACCCCATCAGATCTAC |
|  | TTGAACCGGGAAGATTTACTGCGCAATACTCCGTCGCCAGGAGATTTTTATCCATTTTAAAAGACAACCGTGAGA |
|  | AGATTGAAAAATTTAACTTTCGATTCCATATTACGTCGGGCCTGGAATTTTGCCCGAGGTAACTCTCGATT |
|  | CGCCTGGATGCGACGAGAAAAGCGAGGAGACCATCACTCCCGTGAATTTTGAAGAGGTTGTTGATAAAG |
|  | GCGCAGCGCCCAGTCGTTATCGAACGTATGACCCAACTTGTAATAAAATCTGCCGAATGAAAAGTGC |
|  | TTCCGAAGCATTCTCTGTTGTTATGAATATTTCTGTCGGAGAACAGAAAAAGCAATTGTGACCTGCTGTCAA |
|  | CGAAGGCATGCGGAAACCTGCTTTCTCCGGAGAAGAGACTACTTCAAAAAATCGAATGCTTCCACT |
|  | AACGACCGGAAAGTAACTGGAAGCAGCTGAAGCGAGCCTGAAACTACGCAGTCTGGCCACATTCTGAAGATATTGTTTGAAA |
|  | CAGTAGAGATCTCTGGTGTTGAAGATCGTTCAACGCGAGTCTGGAACTACCATGATTGTTGAAA |
|  | TCATCAAAGATAAAGACTTTCTGGATAACGAAGACAGCGAATGAGGAGCACATTCTGAAGATATTCTTGACAC |
|  | TGACTCTGTTTGAGGATCGGCAAACGTCGCCGAAACGTATGCCCATTATTCCGATGACA |
|  | AAGTCATGAGAGCAGCTGAAACGTCAAAACTATCTTAGATTTCCTGAAGAGACATTGGATTGCCAACCGA |
|  | GTATAAGAGACAAACAGAATTCATCAAAACTATCTTAGATTTCCTGAAGAGACATTGGATTGCCAACCGA |
|  | ATTTTATGCAGCTGTATTCGCTCGATGATCGCTCGATGAACAATTGCCAACATTCAGAAGGCGCAGGTCAGCG |
|  | GCCAGGGTGATTCGCTCATGAACAATCAGACTACTCAAAAAGTCAAAACGGTCAGGTCCAGAAAATATGTGTA |
|  | TCGAAATGCCCGGAAAATCAGATTCGCAGAAATTCAGAAAGTCCAACACTCTCAAAAGTCAAGACTCACTGTCACCGAGAAAATATTGTGA |
|  | ATTGAAGAAGCATCAAAAGCTATCTGTATTATCTCAGATCCAGCAGACTTAAAAGAACCGGTTGAGAACGT |
|  | GCAGAATGAAAAACTGTATCTGTATTATCTCAGATCCAGATTAAACCGCGTGACATGTGTTGATCAAGAACTGGA |
|  | TATCAATCGCTTTGTCGATTATGACGTGGATATCATATTGTCCGCAAAGCTTTGAAAAGACGATTCTATT |
|  | GACAATAAGTACTGACACGTTCGACACAAAAACCGTCTAAAAGCGTAAACGCTACCGTCGGAAGAAGT |
|  | TGTTAAGAAATGAAAAATATTGCGCCCAACTCTGAATGCTAAATTGATTACCAGCCAGCGGAAATTGA |

TABLE 6-continued

SEQUENCE LISTING

| SEQ ID NO: | Sequence |
|---|---|
| | TAACTTAACCAAAGCCGAGCGGGGTGGCTTAAGTGAACTGGATAAAGCCGGTTTTATTAAACGCCAACT |
| | GGTAGAAACCCGCCAGATAACGAAACATGTGAATCCTCAGATAGTCGCCATGAATACGAAATATGA |
| | CGAAAGATGATAAATTGATCCGTGAATGTAAAGTGATTACTCTTAAAGCAAATTGTATCGATTTTCG |
| | GAAAGATTTCCAATTCTATAAGGTGAGAGAAATTAACAATTACCATCATGCCACATGATGCTATTTAAA |
| | TGCAGTTGTTGGCACCGCCTTAATCAAAAATATCCGAAATTAGAATCTGAGTTCGTATGGTGATTAT |
| | AAAGTTTATGATGTTCGAAAAAATGAATTTTTTAAAACTGAGATTACCCTGGCAAATGGCGAAATTGCCAAAC |
| | TTTTTTATAGCAATATATGAAATTTTTAAAACTGAGATTACCCTGGCAAATGGCGAAATTGCCAAAC |
| | GTCCCTCTGATTGAAACCAATGCCGAAACCGGCAGGTGAATATTGTCAAGAAAACGAAGTTCAGACAGGCGGTTTTA |
| | TCCGGAAAGTCCCTGTCAATGCCGAAACCAATGCCGAAGTCGCGAGCTAATTGATTGCCCGCAAGAAAGATTGGGATCCGA |
| | GTAAAGAGTCTATTCTGCCCAAACGTAATTCGATAAATTGATTGCCCGCAAGAAAGATTGGGATCCGA |
| | AGAAATATGGTGGATTCGATTCTCCGACGGTTCGCTATAGCGTTCTAGTCGTCGCCAAGGTCGAAAAG |
| | GTAAATCCAAAAAACTGAAATCTGTGAAAGAACTGTTAGGCATTACAATCATGGAACGTAGTAGTTTTG |
| | AAAGAACCCGATGACTTCCTCGAGGCGAAGGCTACAAAGGAAGTCAAGAAGAGTTGATTATTAAA |
| | CTCCCAAAAATATTCATTATTGAGTTAGAAAACGGTAGGAAGCCTATGCTGGCAGTCGTGGGAATTA |
| | CAGAAGGGGAATGAGTAGCACTGCCGCTCCTGCCCATTCCCTCAAAATATGGAACTTTCTGTATCTGCCCATTACGAG |
| | AAACTGAAAGGTAGCCCGGAAGATAATGAACAGAAACAACTATTTGTCGAGCAACAACATTATCT |
| | GGATGAAAATTATTGAACAGATTAGTGAATTCTCTAAACGTGTATTTTAGCGATGCCAACCTTGACAAG |
| | GTGCTGAGCGCATATAATAATAAACACCGTGATTAAACCCATTCGTGAACAGGCTGAAAAAATATCATACATCTG |
| | TTCACGTTAACCAACTTGGGAGCTTCCGCCGCTTTTTAAATAATATTCGATACCAATTGACCGCAAACGTT |
| | ATACGTTCTACAAAAGAGGTGCTCGATGCGACCCTGATCCGACCCAGTCTATTACAGGCCTGTATGAAACTC |
| | GTATCGACCTGTCACAACTGGGCGGCGACTGA |

| SEQ ID NO: 169 | ATGGACAAGAAATATTCAATCGTTTAGCAATAGGAACTAACTCAGTAGGTTGGGCTGTAATTACAGAC |
| | GAATCAAGTACCGTCCAAAAGTTAAGGTGTTGGGGAACACAGAGCCGACACGTCTGAAGAGAACCGCTAG |
| | TTTAATAGCGCCTTTACTTTTCGATTCAGCCGAAACTGCAGAGAACGCCGACACGTCTGAAGAGAACCGCTAG |
| | ACGTAGATACACGGACGAGGAACAGACAGAATATGTTACCTACAAGAATGCTGAAGATGCTAA |
| | GGTGATGATGATTCGTTTTTTCATAGCTCGAGAATCTTCTTAGTGAAGATAAAAACGAAAG |
| | GCATCCTATCTTTGGAAACATAGTTGATGCCTTACCACAGAAGCGGATCTAAGGTTAATTTAACCACTATATCACCTT |
| | AGAAAAAAGTTGGTTGATTCAACCGACAAGCGGATCTAAGGTTAATTTAACCACTATATCACCTT |
| | ATAAATTTAGAGGACATTCTTTGATCGAAGGTGATTTAAATCCCGATAACTCTGATGTAGATAAACTGT |
| | TCATCCAGTTGGTTCAAACATATAATCAGTTGTTCGAAGAGAACCCATTAACGCATCCAGGTGTTGATGC |
| | TAAAGCAATCTTATCAGCAAGGTTGCAGCAGAGCAGACGTCTGGAAACTGATTGCCCAATTGCCAGG |
| | TGAAAAGAACGGTCTTTTTGAAGATGCTAAACTCCAGTTATCTAAGGATACATATGACGATGATTTGATAATC |
| | AATTTCGACCTCGCTGGAGGATGCTAAACTCCAGTTATCTAAGGATACATATGACGATGATTTGATAATC |
| | TATTGGCCCAGATGGTGATCAGTATGCCAGATTTGTTTTTTGGCACCTTAGCTCTGCATCTATGATGCAATTCT |
| | ACTGAGCGATATTTTAAGGTGACATACAGAATAACTAAAGCACCTTTGCTTAGCTCTGCATCTATGATGAATAAAG |
| | ATACGATGAACACCATCAAGATCTCACACTTAGTTAGTAGACAACAATTACCAGAAAATA |
| | TAAAGAAATCTTTTCGATCAGTCCAAGAACGGATACGCCGGCTATAGATAGATGGCGGTGCCTCCCAAGA |
| | AGAATTTACAAATTTTAAGAAACAAAACCCATTTGTGAAAATGATGGTTCTATTCCACCCAAATCCATCTA |
| | AACAGGGAAGAGATTATTAAGAAACAAAACCCATTTGTGAAAATGATGGTTCTATTCCACCCAAATCCATCTA |
| | GGGGAATTACATGCGATTCTTAGAAGACAAGAAGAATTTTATCCATTCTTGAAAGATAACAGGGAAAAG |
| | ATAGAGAAAATCTTAACTTTAGAATTCCCTACGTCGGGCCCTTGGAATTTGAAGAAGTTGTTGATAAGGAG |
| | CCTGATGACGACGCAAATCTTTATTGAACAATGACCAATTTGATAAGAATTACCCAATGAAAAGGTCTACC |
| | CAAACATTCACTCCTATACGAGTACTTACTGTTGAACAAAAGAAGGCCATTGTTGACTTGTTATTCAAACTA |
| | GGTATGCCGAAAACTGCCTTTCTCGAGTGGTGAACAAAAGAAGGCCATTGTTGACTTGTTATTCAAACTA |
| | ACAGAAAGGTCACTGTGAAGCAGCTTAAAGAAGATTATTCAAAAAGATCGAATGTTTCGACTCGTAG |
| | AAATTAGTAGCGTGTGGAAGATAATGAAGAAATGAAGATATTCTTCTTGAAGACATATCATCATGATCATCAA |
| | AGATAAAGATTTCTTGGACAATGATAAGAAGAAATGAAGAAATATATCATCATCATCATCAA |
| | AGATAAAGATTTCTTGGACAATGATAAGAAGAAATGAAGATATTCTTGAAGACATCGTTTGAACACTTACATT |

TABLE 6-continued

SEQUENCE LISTING

| SEQ ID NO: | Sequence |
|---|---|
| | GTTTGAGGACAGAGAAATGATTGAAGAAAGGCTGAAGACCTACGCCCATTTGTTTGATGATAAAGTCAT<br>GAAACAGTTAAAGAGGAGAAGGTATACCGATGGGTAGGCTGTCTCGCAAATTGATTAATGGTATTCG<br>TGATAAACAATCGGGTAACGATTCTTTGACTTTTAAAGAGGATATTCAGAAAGCACAGGTCCAGGACGGGC<br>CAATTGATTCATGACGATTCTTTGACTTTTAAAGAGGATATTCAGAAAGCACAGGTCCAGGACGGGC<br>GATTCACTCCATGAGACGAACTTGTTAAAGTTATGGAAGACACAAACCTGAAAATATCGTTATTGAAATGG<br>TCAAAGTAGTAGACGAACTTGTTAAAGTTATGGAAGACACAAACCTGAAAATATCGTTATTGAAATGG<br>CTCGCGAAAACCAGACAACCAAAAGAATTCAAAAGAATTCAGTAGAAACACTCAGCTTCAAAATGA<br>AGTTATTAAAGAACTTGGGTCCCAAATACTTAAAGAACATCCAGTAGAAACACTCAGCTTCAAAATGA<br>AAAATTATACTTATATTCTTCAGAATGCCGCATATGTATGTTGACCAAGAGTTAGATATAAATAGG<br>TTGTCTGATTACGACGTGATCATATTGTACCTCAATCTTTTCTAAAAGATGATTCAATTGATATAATAAGG<br>TATTAACGAGAAGTGATAATATAGACGAAGTAAATCTGCCAACGCAAGAGGTGTGAAGAAA<br>ATGAAAAATTATTGGCGTCAACTGTTGAACGCCAAGTTAATTACCGAGAGAAAGTTTGATAATCTAACA<br>AAAGCTGAAAGAGAGGCCTATCTGAGTTAGATAAGGCCGGTTTATCAAACGTCAGTTAGTTGAAACC<br>AAACTGATTCGGAAGTCAAGGTTATAACTCAAAAAGCAACATAGTTTCAGATTTTCGCAAAGATTTTC<br>AATTTTACAAAGTTCGAGAAATATCTAAACTGGAATTATCATCGGAATTCGAATTTGTATATGGGATTACAAAGTATACGA<br>TACAGCTTTAATAAAGAAATATCTAAACTGGAATTCGAATTTGTATATGGGATTACAAAGTATACGA<br>CGTGAGAAGATGATCGCTAAATTGAACAAGAAATTGGGAAAGCAACTGCAAATATTTTTTTACAG<br>CAACATAATGAATTTTTTAAAACGGAAATTACATTGCAAATGGCAAATTAGAAAGCGCCCATTGAT<br>AGAGACCAATGGAGAGACTGGGGAAATCGTGTGGGATAAAGGACGTGATTTTGCCACAGTGAGGAAAG<br>TGTTAAGTATGCCACAAGTTAATATTGTAAAAGACCGAAGTCCAAACGGGTGGATTAGCACAAGAAT<br>CAATTTTACCTAAGAGAATTCAGATAGAAATTGCCCGCAACAAAGGATTGGGATCCTAAAAAATATG<br>GTGGTTTGATTCCCCAACAGTTGCTTACTCCCGTCTACTTGTTGCTAAGGTTGAAAAAGGAAAGTCTAA<br>GAAACTTAAATCCGTAAAGAGTTACTGGGAATTACAATAGGATCAAAAGAAGTCAAAAGAATGAAAGAACCC<br>TATTGACTTCTTGAGGCGAAAGTTATAAAGAGTCAAAAGAAGTGATCATCATAAAACTACCAAAGTA<br>TTCTCTATTGAATTGGAAATACGCAGAAAAGATGGTTCCAAGCGCTGGTGAACTACAAAAGGTAA<br>CGAATTGGCATTGCCAGGATAACGAGCAGAAACAACTGTTTGTTGAACAACAACATTATCTTGATGAATTAT<br>ATCCCCGAGGATAACGAGCAGAAACAACTGTTTGTTGAACAACAACATTATCTTGATGAATTAT<br>AGAACAAATTAGTGAGTTCAGTAAGGAAGTGTATTTAGCCGATGCAAATTATTCATTGTTACGTTAACA<br>TATAACAAACATAGAGATAGCCTATAAGGGAACAAGCCGAAAATATTATTCATTTGTTTACGTTAACA<br>AATTTAGGGGCACCCAGCATTCAACTTTGATTCATCAATCTATAACAGGCTTATAACAGAATCGATCTGT<br>AAAGAGTTCTTGATGCAACTTGATTCATCAATCTATAACAGGCTTATAACAGAATCGATCTGT<br>CACAACTTGGTGGTGACTAA |
| SEQ ID NO: 170 | ATGGACAAGAAGTACTCAATTGGCTTGCTCATCGGCACTAACGCGTTGCGTGGCGTCATCACAGAC<br>GAATATAAGGTCCCATCAAAAGAAATTCAAAGTCCTTGGCAATACGGCCACATTCAATCAAGAAGAAC<br>CTGATTGGAGCTCTGCTGTTTGATTCCGGTGAAACCGCCGAGGCAACACCGATTGAAACGTACCGCTCGT<br>AGGAGGTATACGGCGGCGAAAAATGAGGATCGTCATCTGCAGGAGAATCTTTCCGTGGAAGAAGACACGAGCG<br>GGTAGACGACAGCTTCTTCACCGGCCTCGAGGAATCTTTCCGTGGAAGAAGACACAAAAAAGCACGAGCG<br>CCACCCCATTTCGCAATATCGTGGAGTAGCTTACCACGAAAAGTATCCAACTATTACCACTTA<br>CGTAAGAAGTTAGTGGACAGCACCACCATTCTTGATAGAGGGAGACCCGACTCTGATTTACCTGCACACATG<br>ATTAAGTTCCGAGCCCACTTCTTGATAGAGGGAGACCCGACTCTGATTTACCTGCACACATG<br>TCATCCAGCTGGTACAGACATAATCAGTTGTTTGAGGAAAATCCGATTAATGCCAGTGGCGTGACG<br>CCAAGGCTATCCGTCTCGCTGCCTAGTAGAGTAGACGCGTTGAAAATCTAATCGCCACGCTGCCCG<br>GCGAAAAGAAAATGGACTTTCGTAATTTGATCGCCCTGAGCCTGGGCCTCACCCCTAACTTTAAGT<br>CTAACTTCGACCTGGCCGAAGATATTCGGGACCAGTAACGTACGTAAGCTCCAAGATACTTAACGATGACGCCAT<br>ATCTCCTGCCGATATTCGGGACCAGTAACGTACGTAAGCTCCAAGATACTTAACGATGACGCCAT<br>TCTCCTGCCGATATTCTGAGGGTTAACACTGAAATTGATCGCTGAAATTACAAAGGCCCCCTGAGCGCGAGCAATCAA<br>AAGGTACGACGAGCATCACCAGGACCTCACGCTGCTTAGTCAGAGACACGTCAGAACACGTCAGAACTGCCCGAAA |

TABLE 6-continued

SEQUENCE LISTING

| SEQ ID NO: | Sequence |
|---|---|
| | AGTACAAAGAAATCTTTTCGACCAATCCAAGACGGGTACGCCGGCTACACCATTGATGGCGGGCTTCAC |
| | AAGAGGAGTTTACAAGTTTATCAAGCCATCCTGGAGAAATGACGCCACTGAAGACTGCTTGTGA |
| | AACTCAATAGGAGAAGACTTACTGAGGAAACAGACTTGATAATGGTCCATACCCCACCAAATCC |
| | ATCTGGGAGAGTTGCATGCCATCTTGCGAAGGCAGGAGGACTTCTACCCCTTTCTTAAGGACAACAGGG |
| | AGAAAATCGAGAAATTCTGACTTTCCGTATCCCTACTACGTGGGCCACTTGCTCGCGGAAACTCACG |
| | ATTCCATGATGACGAGAAAGTTCGAGAGAAACAATTACACCCTGGAATTTTGAGGAGTAGTAGACAA |
| | GGGACCAGCGCTCAATCTTTCATTGAGAAGTGATGAGCAGAAACCTTCCAAACGAGAAAGT |
| | GCTTCCTAAGCACAGCCTGCTGTATGAGATATTTCACGGTGTACAACGAACTTACGAAGGTCAAGTATGTG |
| | ACAGAGGGTATGCGGAAACCTGCTTTTCTGTCTGTGAACAGAAGGAGGATTACTTCAAGAAGATCGAGTGTTTTGATT |
| | AAACCAACCGAAAGGTGACGGTGAAACAGTTGAAGAGAGATTACTTCAAGAAGATCGAGTGTTTTGATT |
| | CTGTTGAAATTTCTGGGGTCGAGGATAGATTCAACGCCAGCCTGACACTTCCTAAAGAGCATGAGTTCTGAAGAT |
| | TATCAAGGATAAGGATTTTCTGGATAATGAGAGGAGAATGAAGACATTTTGGAGGATATAGTGCTGACCCT |
| | CACCCTGTTCGAGGACCGGGAGATGATCGAGGAGGACGCCGTTACAACAGCGGCTGGGGAAGCATACTCCCGCAAATTAATCAACGG |
| | GATACGCGATAAACAAAGTGCAGAAACGACCATACTGACTTCCTAAAGAGACGATGATTCGCAAATCGCAA |
| | TTTCATGCAGTTGATCCCTGCACGACAACACATTGCTAACTTGGCTGGATCACCAGCCATTCAGAAAGCGCAGGTGAGTGG |
| | TCAAGGGGATTCCCTGCACGACAACACATTGCTAACTTGGCTGGATCACCAGCCATTCAGAAAGCGCAGGTGAGTGG |
| | GCAGACCGTTAAAGTTGGTAGATGAGCTCATGGAAGTCATGGGAAGACATAAGCCAGAGAACATAGTGA |
| | TCGAAATGGCCAGGGAAAATCAGACACCCAAAAGGGACGAAAGAACTCAAGAGAGCGTATGAAGAG |
| | GATCGAGGAGGCATCAAGGAGCTGGGTAGCCAGATCTGTGAAAGTCCTTAAAGAGTGAAGAATACCCAGC |
| | TGCAGAATGAGAAACTTTATCTCTATTATCTCCAGAACGGAAGGGATATGTATGTCGACCAGGAACTGG |
| | ACATCAATCGGCTAGTGATTATGACGTCGACCATTGTGCCTCAAAGCTTTCTGAAGGATGATTCCAT |
| | CGACAATAAAGTTCTGACCCCGGTCTGATAAAAATAGAGGCAAATCCGACAACTACCTAGCGAAGAAG |
| | TCGTCAAAATCTTCTGAGAAATGAAGAACTATTGGAGGCAGTTGCTGAATGCCAAGCTGATTACACAACGCAAGTTG |
| | ACAATCTCACCCAAGGCAGAAAGGGGCCTGTCAGAACTCGACAAAGCAGGTTTCATTAAAGGCAG |
| | CTAGTTGAAACTAGGCAGATTACTAAGCACGTGGCCCACGAGATCTCGACTCACGGATGAATACAAAGTAT |
| | GATGAGAATGATAAGCTAATCCGGAGGTCGAAGGTGATTACTCTGAAATCTAAGCTGGTGTCAGATTTC |
| | AGAAAAGACTTCCAGTTCTACAAAGTCAGAGAGATCAACAATTATCACCATGCCACGATGACATATCTT |
| | AATGCAGTAGTGGGGACAGCTCTGATCAAAAATAATGACCAAGAGCGAGCAGGAGATTACATTGGCTAACGCTGAGATCCGC |
| | TATAAGTTCATGACGTCAGAAAATCATGAACTTTTTCAAACTGAGATTACATTGGCTAACGGCAGATCCGC |
| | GTACTTCTTTTTACAGTTCATCCATGGAGTAATATCATGAACTTTTCAAACTGAGATTACATTGGCTAACGGCAGATCCGC |
| | AAGCCGCCACTGATAGAGCTAACGAGAGCAGGGAGATTGTTTGGGATAAGGCCCTGACTTCGC |
| | CACCGTTAGGAGAAAGTGCTGTCCATGCCCCAGTGAACATTGTGAAGAAGACAGAAGTGCAGACGGGTG |
| | GGTTCTCAAAAGAGTCTATTCTGCCTAAGCGGAATAGTGACAAACTGATCGCACGTAAAAAGGACTGGG |
| | ATCCAAAAAGATACGGCGATTCGACAGTCCAGTGATTCTACCGTTGCATATTCCGTGCTTGGTCCTAAGGTGG |
| | AGAGGGAAAAAGACAAGAAACCCAAGAAACTACTGGGCATAACGATCATCATGAGCGCTCC |
| | AGTTTCGAAAAAAACCCAATCGATTTTCTTGAACTCGATTTTCTTGAACTCGGAGAATGGGAGGAAGGCATGCGGACATCAGCTGGA |
| | ATTAAGCTGCCTAAGTACAGTCGTCTTGACCCCGACCGTCCCCAAAGTATGTCAAATTTTCTGGCTTCTCACT |
| | GAACTCCAAAAGACGACAGTCTGTTGGCCCCTCCCCAAAGTATGTCAAATTTTCTGGCTTCTCACT |
| | ACGAGAAGTTAAAGGGTCTCGATCCGGATAATGAGCAGAAACAGCTGTTTGTGAACAGCACAAGCAC |
| | TATTTGGACGAAATCATCCGCATACAACATTTCCAGGTTCAGTAAGAGGTGATTCTGCCGACGCAAACTT |
| | GACAAGTTCTGTCCGTCACTCATTAATCTGGGCCCCGCAGCATTTAAATATTTCGATACAACAATGACCGG |
| | AAGCCGTAATCATCTACTAAGGAAGTCCTCGATGCGACACTGATCCACCACTGATCCAATTACAGGTTTATAT |
| | GAAACAAGAATCGACCTGTCCCAGCTGGGGGCGACTAG |

SEQ ID NO: 171 | AAAATTCcatGCAAAATGCTCCGGTTTCATGTCATCAAAATGACGTAATTAAGCATTGATAATTGAGA
TCCCTCCCCTGACGAGGATGATTTACTAATAATAGTGACAAAAATAATTATTTATCCAGAAAT
GAATTGGAAAATCAGGAGAGCGTTTCAATCCTACCTCTGCCGCCAGTTGATATGCaaaCAGGTtgccgtcactgc TABLE 6-continued

SEQUENCE LISTING

SEQ ID NO: Sequence gtcattactggctcactcgctaaccaaaccggtaaccccgctttattaaaagcattctgtaacaaagcattctgtaacaaagcgtaacaaaagtgtctataat
cacggcagaaagtccacattgattatagcacggcgtcacactagctactgcctatgccactagctactgcctatgacaaaaacgcatgacaatctcacctactg
tactccatccggttataggcgtacacccgctatcctcgtgaatagccgagataccgaactaaagAGGAGataccATGGAACAGGAATATT
ATCTGGGCTTGGACATGGCACCGGTTCCGTCCGCTGGGCTGTTACTGACAGTGAATATCACGTTCTAAG
AAAGCATGGTAAGGCATTGTGGGGTGTAAGACTTTTCGAATCTGCTTCCACTGCTGAAGAGCGTAGAAT
GTTTAGAACGAGTCGACGTAGCCTAGGCTAGACAGGCGCAATTGGAGAATCAGAAATTTACAGAAATTTTGC
GGAAGAGATATCTAAGAAAGACCCAGGCTTTTTCCTGAGAATGAAGGAATCTAAGTATTACCCTGAGGA
TAAAAGAGATATAAAATGTAACTGTCCCGAATTGCCTTACGCATTATTTTGTGACGATGATTTTACCGAT
AAGGATTACCATAAAAAGTTCCCACTATCTACCCATTACGCAAAATGTTAATGAATACAGAGAAACC
CCAGACATAAGACTAGTTTATCTGCAATACACCCCATATGATGAAACATAGAGGCCATTTCTTACTTTCCG
GGGATATCAACGAAATCAAAGAGTTTGGTACCACATTTAGTAAGTTACTGGAAACATAAAGAATGAAG
AATTTGATTGGAACTTAGAACTCGGAAAAGAAGAATACGCGGTTGTCGAATCTATCCTGAAGGATAATA
TGCTGAATAGGTCGACCAAAAAAACTAGGCTGATCAAAGCACTGAAGCCAAATCTATCTGCGAAAAA
GCTGTTTTAAATTTACTTGCTGGTGGCACTGTTAAGTTATCAGACATTTTGGTTGGAAGAATTGAACG
AAACCGAGCGTCCAAAAATTAGTTTCGCTGATAATGGCTACAGCATTACCATTGTGAGGTGGAAAACG
AGTTGGGCGAACAATTTATATATAGAGACAGCTAAGGCAGTCTATGACTCGGCGTGTTTAGTAGAAA
TCCTTGGTAAATACACATCTATCTCCGAAGCGAAAGTTGCTACTTACGAAAAGCACAAGTCCGATCTCCA
GTTTTTGAAGAAAATGTCAGGAAAATATCGACTAAGGAAGAATATAGAAGATATTTTCGTTAGTACCTCT
GACAAACTGAAAAATTACTCCCGTTACATCGGGATGACCAAGATTAATGGCAAAAAAGTTGATCTGCAA
AGCAAAAGGTGTTCGAAGGAAGAATTTATGATTTCATTAAAAGAGAGACATTCTTACCAAACAAGTCAACAG
CAGCCAGAATACGAATATTTGAAAGAAGAACTGAAATGGAAGAATTTAGGCAATTTACGCGAT
AAAATTGACCTTATCAACGAGAAAATGAGATAAGCTGGTTCAACTCTTTGAATTCAGAATACCCTATATG
TGGGCCCACTGAACAACGATTGATGACGCAAAGAAGGGTAAATTCACATGGGCCGTCCGCAATCAATG
AAAAATTTACCCATGGAACTTTGAAAATGTAGTAGATATTGAAGGCGTCTGCCGAGAAAATTTATTCGAA
GAATGACTAATAAATGCACTTACTTGATGGGAGGATGTTCTGCCTAAAGACAGCTTATTATACAGCA
AGTACACTGGTTCTAAACGAACTAACAACGTAACCGAGATGACGTGAGAAATTAAGTGTAGAATTACTTGA
AAAGATTGTATACTGACGTCTTCTCCAAGTACAGAAGAAAAGTGACAGTTAAAAAATTAAGAATTACTTGA
AGTGCGAAGGTATAATTTCTGGAAACGTAGAGATTACTGGTATTGATGGTGATTTCAAAGCATCCCTAA
CAGCTTACCACGATTTCAAGGAAAATTTCGACGGAAATCCTGACAGGAACTGAACTGCCAAAAAAGATAAGAAAACATT
ATTACTAATATTGTTCTTTTCGGTGATGACAAGACAAGAAATTGTTGAAGAAAAAGACTGAATAGACTTTACCCCC
AGATAATCTCCAATCAACTTAAGAAATTTGTGCTTGTCTTACACAGGATGGGTCGTTTTCAAAAA
GTTCTTAGAGAGAATTACCCGACCCCACCTGATCCAGAAACAGGCGAAGTATGGAATATAATTACCGCCTTATG
GGAATCGAACAATAATCTTCTGAGCAATGAATATCGTTTCATGGAAGAAGTTGAGACTTA
CAACATGGCAAACGACGAAGACTTTATCCTATGCAAACTGTGAAAATAATATGTATGTATCACCTTCTGT
CAAGAGACAAATTTGGCAAACCTTAAAAATGTCAAAGATTAGAAAGTAATGAAGGAGTCTCCTA
AACGTGTGTTTATTGAAATGCCTAGAGAAATGCTAGAGAAAAACGAAGAGAAAGATTGGGTTAAAGAATTGGGGAGCCAAGA
TTAATCGATTTATATAAGGCTTGTAAAAACGAAGAGAAAGATTGGTTATTTATACCGGCAAAAGGGACGATGTATGTATTCCGG
GGAACAAAAACTACGGTCGGATAAGTTTGTATTATTACATATACCGCAAGAATATCACCATATATTCCCAATC
CGGAGTAATAGAATTGAAGGATTTATGGACAATAGAATATGACATAGACCATATATATTCGACCAAATCTG
AAAAACGATGGACGATAGCTTGAACAATAGCTTCGTGAAAAAAATATAATGCGACCAAATCTG
ATAAGTATCCTCTGAATGAAGAAAATATCAGACATGAAAGAAAAGGGGTTCTGGAAGTCCTTGTTAGATGGTG
GGTTATAACGAAGAAGTAAGGAAAATACGAGCGTCTAATTAAGAAAACCACCAGAGTTATCGCCAGAAGAACTCGCT
GGTTTATTGAGAGGCAAATCGTGAGAATTGTCTATGTCAAAGTGGCACAGTTAGGAAAGACTTCGAA
GTTTCCCAGAAGGTCGGAGATTGAACCAGATTTCATCACGCAAAGGACGCCTTACCTAAATATCGTTCGTAGGT
CTATTAAAAGGTAAGAAGAAGTGAACATTTACCAAAGAACGCCTCTTGGTTTATAAGGAAAACCAGGTAAGAAACATAT
AACCTGAAAAAGATGTTCACCTCTGGTTCGAATATGAACAAATTAATGAACAAAAATAATATCCTCGTTACAAGGCAGGT
AAGAAAGGGACTATAGTGACAGTAAGACATAAGCAATTATGAACAAAATAATATCCTCGTTACAAGGCAGGT TABLE 6-continued

SEQUENCE LISTING

| SEQ ID NO: | Sequence |
|---|---|
| | TCATGAAGCAAAGGCGGCCTTTTTGACCAACAAATTATGAAGAAGGAAAGGTCAAATTGCAATAA
AAGAAACCGATGAGAGACTAGCGTCAATAGAAAAGTATGGTGGCTATATAAAGCTGCGGTGCATAC
TTTATGCTTGTTGAATCAAAAGACAAGAAAGGTAAGACTATTAGAACTATTAGAATTATACCCCTGTACC
TTAAAAACAAAATTGAATCGATGAGTCAATCGCCGTTAAATTTCTAGAGAAAGGAAGGGGTTTAAAAG
AACCAAAGATCCTGTTAAAAAAGATTAAGATTGACACCTTGTTCGATGTAGATGATTAAAATGTGGT
TATCTGGCAGAACAGGCGATAGACTTTTGTTTAAGTGCGCTAATCAATTAATTTTGATGAGAAAATCAT
TGTCACAATGAAAAAAATAGTTAAGTTTATTCAGAAGACAAGAAAACAGGGAGTTGAAATTATCTGA
TAAAGATGGTATCGACAATGAAGTTTTAATGGAAATCTACAATACATTCGTTGATAAACTTGAAAATAC
CGTATATCGAATCAGGTTAAGTGAACAAGCCAAAACTAATTGATAAACAAAAGAATTTGAAAGGCT
ATCACTGGAAGACAAATCCTCCACCCTATTTGAAATTTTGCATATATTCCAGTGCCAATCTTCAGCAGCT
AATTTAAAAATGATTGGCGACCTGGGAAAGCCGGCATCCTAGTGATGAACAATAATATCTCCAAGTGT
AACAAAATATCAATTATTAACCAATCTCCGACAGGTATTTTTGAAAATGAAATAGACTTGCTTAAGATAT
AAGAAATCATCCTTAGCGAAAGCTAAGGATTTTTTTATCTGAAATTTATTATCGCGTTGATTATTGAT
GCTGTTTTAGTTTTAACGGCCAATTAATAATATGTGTTATTAATTGAATGAATTTTATCATTCATAATAAGT
ATGTGTAGGATCAAGCTCAGGTTAAATAATATCACTCAGGAAGTATTACTCAGGAAGCAAGAGGATTAC
AGAATTATCTCATAACAAGTGTTAAGGGATGTTATTTCC |
| SEQ ID NO: 172 | AATTCAAAGGATAATCAAAC |
| SEQ ID NO: 173 | AATTCTACTCTTTGTAGAT |
| SEQ ID NO: 174 | AATTTCTACTGTTGTAGAT |
| SEQ ID NO: 175 | AATTTCTACTAGTGTAGAT |
| SEQ ID NO: 176 | AATTTCTACTATTGT |
| SEQ ID NO: 177 | AATTTCTACTGTTGTAGA |
| SEQ ID NO: 178 | AATTTCTACTATTGTA |
| SEQ ID NO: 179 | AATTTCTACTTTTGTAGAT |
| SEQ ID NO: 180 | AATTTCTACTGTTGTAGAT |
| SEQ ID NO: 181 | AATTTCTACTCTTGTAGAT |

SEQUENCE LISTING (205 sequences)

SEQ ID NO: 1 - protein, 1358 aa, Artificial Sequence
  Description of Artificial Sequence: Synthetic polypeptide
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 2 - protein, 1334 aa, Artificial Sequence
  Description of Artificial Sequence: Synthetic polypeptide
MSSLTKFTNKYSKQLTIKNELIPVGKTLENIKENGLIDGDEQLNENYQKAKIIVDDFLRDFINKALNNTQIGNWRELADALNKEDEDNIEKLQDKIRGIIVSKFETFDLFSSYSIKKDEKIIDDDNDVEEEELDLGKKTSSFKYIFKKNLFKLVLPSYLKTTNQDKLKIISSFDNFSTYFRGFFENRKNIFTKKPISTSIAYRIVHDNFPKFLDNIRCFNVWQTECPQLIVKADNYLKSKNVIAKDKSLANYFTVGAYDYFLSQNGIDFYNNIIGGLPAFAGHEKIQGLNEFINQECQKDSELKSKLKNRHAFKMAVLFKQILSDREKSFVIDEFESDAQVIDAVKNFYAEQCKDNNVIFNLLNLIKNIAFLSDDELDGIFIEGKYLSSVSQKLYSDWSKLRNDIEDSANSKQGNKELAKKIKTNKGDVEKAISKYEFSLSELNSIVHDNTKFSDLLSCTLHKVASEKLVKVNEGDWPKHLKNNEEKQKIKEPLDALLEIYNTLLIFNCKSFNKNGNFYVDYDRCINELSSVVYLYNKTRNYCTKKPYNTDKFKLNFNSPQLGEGFSKSKENDCLTLLFKKDDNYYVGIIRKGAKINFDDTQAIADNTDNCIFKMNYFLLKDAKKFIPKCSIQLKEVKAHFKKSEDDYILSDKEKFASPLVIKKSTFLLATAHVKGKKGNIKKFQKEYSKENPTEYRNSLNEWIAFCKEFLKTYKAATIFDITTLKKAEEYADIVEFYKDVDNLCYKLEFCPIKTSFIENLIDNGDLYLFRINNKDFSSKSTGTKNLHTLYLQAIFDERNLNNPTIMLNGGAELFYRKESIEQKNRITHKAGSILVNKVCKDGTSLDDKIRNEIYQYENKFIDTLSDEAKKVLPNVIKKEATHDITKDKRFTSDKFFFHCPLTINYKEGDTKQFNNEVLSFLRGNPDINIIGIDRGERNLIYVTVINQKGEILDSVSFNTVTNKSSKIEQTVDYEEKLAVREKERIEAKRSWDSISKIATLKEGYLSAIVHEICLLMIKHNAIVVLENLNAGFKRIRGGLSEKSVYQKFEKMLINKLNYFVSKKESDWNKPSGLLNGLQLSDQFESFEKLGIQSGFIFYVPAAYTSKIDPTTGFANVLNLSKVRNVDAIKSFFSNFNEISYSKKEALFKFSFDLDSLSKKGFSSFVKFSKSKWNVYTFGERIIKPKNKQGYREDKRINLTFEMKKLLNEYKVSFDLENNLIPNLTSANLKDTFWKELFFIFKTTLQLRNSVTNGKEDVLISPVKNAKGEFFVSGTHNKTLPQDCDANGAYHIALKGLMILERNNLVREEKDTKKIMAISNVDWFEYVQKRRGVL

SEQ ID NO: 3 - protein, 1238 aa, Artificial Sequence
  Description of Artificial Sequence: Synthetic polypeptide
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDEVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIKRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLPRVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 4 - protein, 1298 aa, Artificial Sequence
  Description of Artificial Sequence: Synthetic polypeptide
MTKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 5 - protein, 1235 aa, Artificial Sequence
  Description of Artificial Sequence: Synthetic polypeptide
MHTGGLLSMDAKEFTGQYPLSKTLRFELRPIGRTWDNLEASGYLAEDRHRAECYPRAKELLDDNHRAFLNRVLPQIDMDWHPIAEAFCKVHKNPGNKELAQDYNLQLSKRRKEISAYLQDADGYKGLFAKPALDEAMKIAKENGNESDIEVLEAFNGFSVYFTGYHESRENIYSDEDMVSVAYRITEDNFPRFVSNALIFDKLNESHPDIISEVSGNLGVDDIGKYFDVSNYNNFLSQAGIDDYNHIIGGHTTEDGLIQAFNVVLNLRHQKDPGFEKIQFKQLYKQILSVRTSKSYIPKQFDNSKEMVDCICDYVSKIEKSETVERALKLVRNISSFDLRGIFVNKKNLRILSNKLIGDWDAIETALMHSSSSENDKKSVYDSAEAFTLDDIFSSVKKFSDASAEDIGNRAEDICRVISETAPFINDLRAVDLDSLNDDGYEAAVSKIRESLEPYMDLFHELEIFSVGDEFPKCAAFYSELEEVSEQLIEIIPLFNKARSFCTRKRYSTDKIKVNLKFPTLADGWDLNKERDNKAAILRKDGKYYLAILDMKKDLSSIRTSDEDESSFEKMEYKLLPSPVKMLPKIFVKSKAAKEKYGLTDRMLECYDKGMHKSGSAFDLGFCHELIDYYKRCIAEYPGWDVFDFKFRETSDYGSMKEFNEDVAGAGYYMSLRKIPCSEVYRLLDEKSIYLFQIYNKDYSENAHGNKNMHTMYWEGLFSPQNLESPVFKLSGGAELFFRKSSIPNDAKTVHPKGSVLVPRNDVNGRRIPDSIYRELTRYFNRGDCRISDEAKSYLDKVKTKKADHDIVKDRRFTVDKMMFHVPIAMNFKAISKPNLNKKVIDGIIDDQDLKIIGIDRGERNLIYVTMVDRKGNILYQDSLNILNGYDYRKALDVREYDNKEARRNWTKVEGIRKMKEGYLSLAVSKLADMIIENNAIIVMEDLNHGFKAGRSKIEKQVYQKFESMLINKLGYMVLKDKSIDQSGGALHGYQLANHVTTLASVGKQCGVIFYIPAAFTSKIDPTTGFADLFALSNVKNVASMREFFSKMKSVIYDKAEGKFAFTFDYLDYNVKSECGRTLWTVYTVGERFTYSRVNREYVRKVPTDIIYDALQKAGISVEGDLRDRIAESDGDTLKSIFYAFKYALDMRVENREEDYIQSPVKNASGEFFCSKNAGKSLPQDSDANGAYNIALKGILQLRMLSEQYDPNAESIRLPLITNKAWLTFMQSGMKTWKN

SEQ ID NO: 6 - protein, 1260 aa, Artificial Sequence
  Description of Artificial Sequence: Synthetic polypeptide
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKVLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRHYTMDKFQFHVPITMNFKCSAGSKVNDMVNAHIREAKDMHVIGIDRGERNLLYICVIDSRGTILDQISLNTINDIDYHDLLESRDKDRQQERRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHAQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 7 - protein, 1263 aa, Artificial Sequence
  Description of Artificial Sequence: Synthetic polypeptide
MNNGTNNFQNFIGISSLQKTLRNALIPTETTQQFIVKNGIIKEDELRGENRQILKDIMDDYYRGFISETLSSIDDIDWTSLFEKMEIQLKNGDNKDTLIKEQTEYRKAIHKKFANDDRFKNMFSAKLISDILPEFVIHNNNYSASEKEEKTQVIKLFSRFATSFKDYFKNRANCFSADDISSSSCHRIVNDNAEIFFSNALVYRRIVKSLSNDDINKISGDMKDSLKEMSLEEIYSYEKYGEFITQEGISFYNDICGKVNSFMNLYCQKNKENKNLYKLQKLHKQILCIADTSYEVPYKFESDEEVYQSVNGFLDNISSKHIVERLRKIGDNYNGYNLDKIYIVSKFYESVSQKTYRDWETINTALEIHYNNILPGNGKSKADKVKKAVKNDLQKSITEINELVSNYKLCSDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHIKSSKDFDITFCHDLIDYFKNCIAIHPEWKNFGFDFSDTSTYEDISGFYREVELQGYKIDWTYISEKDIDLLQEKGQLYLFQIYNKDFSKKSTGNDNLHTMYLKNLFSEENLKDIVLKLNGEAEIFFRKSSIKNPIIHKKGSILVNRTYEAEEKDQFGNIQIVRKNIPENIYQELYKYFNDKSDKELSDEAAKLKNVVGHHEAATNIVKDYRYTYDKYFLHMPITINFKANKTGFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSEKNLFCFTFDYNNFITQNTVMSKSSWSVYTYGVRIKRRFVNGRFSNESDTIDITKDMEKTLEMTDINWRDGHDLRQDIIDYEIVQHIFEIFRLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 8 - protein, 1318 aa, Artificial Sequence
  Description of Artificial Sequence: Synthetic polypeptide
MTNKFTNQYSLSKTLRFELIPQGKTLEFIQEKGLLSQDKQRAESYQEMKKTIDKFHKYFIDLALSNAKLTHLETYLELYNKSAETKKEQKFKDDLKKVQDNLRKEIVKSFSDGDAKSIFAILDKKELITVELEKWFENNEQKDIYFDEKFKTFTTYFTGFHQNRKNMYSVEPNSTAIAYRLIHENLPKFLENAKAFEKIKQVESLQVNFRELMGEFGDEGLIFVNELEEMFQINYYNDVLSQNGITIYNSIISGFTKNDIKYKGLNEYINNYNQTKDKKDRLPKLKQLYKQILSDRISLSFLPDAFTDGKQVLKAIFDFYKINLLSYTIEGQEESQNLLLLIRQTIENLSSFDTQKIYLKNDTHLTTISQQVFGDFSVFSTALNYWYETKVNPKFETEYSKANEKKREILDKAKAVFTKQDYFSIAFLQEVLSEYILTLDHTSDIVKKHSSNCIADYFKNHFVAKKENETDKTFDFIANITAKYQCIQGILENADQYEDELKQDQKLIDNLKFFLDAILELLHFIKPLHLKSESITEKDTAFYDVFENYYEALSLLTPLYNMVRNYVTQKPYSTEKIKLNFENAQLLNGWDANKEGDYLTTILKKDGNYFLAIMDKKHNKAFQKFPEGKENYEKMVYKLLPGVNKMLPKVFFSNKNIAYFNPSKELLENYKKETHKKGDTFNLEHCHTLIDFFKDSLNKHEDWKYFDFQFSETKSYQDLSGFYREVEHQGYKINFKNIDSEYIDGLVNEGKLFLFQIYSKDFSPFSKGKPNMHTLYWKALFEEQNLQNVIYKLNGQAEIFFRKASIKPKNIILHKKKIKIAKKHFIDKKTKTSEIVPVQTIKNLNMYYQGKISEKELTQDDLRYIDNFSIFNEKNKTIDIIKDKRFTVDKFQFHVPITMNFKATGGSYINQTVLEYLQNNPEVKIIGLDRGERHLVYLTLIDQQGNILKQESLNTITDSKISTPYHKLLDNKENERDLARKNWGTVENIKELKEGYISQVVHKIATLMLEENAIVVMEDLNFGFKRGRFKVEKQIYQKLEKMLIDKLNYLVLKDKQPQELGGLYNALQLTNKFESFQKMGKQSGFLFYVPAWNTSKIDPTTGFVNYFYTKYENVDKAKAFFEKFEAIRFNAEKKYFEFEVKKYSDFNPKAEGTQQAWTICTYGERIETKRQKDQNNKFVSTPINLTEKIEDFLGKNQIVYGDGNCIKSQIASKDDKAFFETLLYWFKMTLQMRNSETRTDIDYLISPVMNDNGTFYNSRDYEKLENPTLPKDADANGAYHIAKKGLMLLNKIDQADLTKKVDLSISNRDWLQFVQKNK

SEQ ID NO: 9 - protein, 1339 aa, Artificial Sequence
  Description of Artificial Sequence: Synthetic polypeptide
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLK

SEQ ID NO: 10 - protein, 1280 aa, Artificial Sequence
  Description of Artificial Sequence: Synthetic polypeptide
MNKFENFTGLYPISKTLRFELIPQGKTLEYIEKSEILENDNYRAEKYEEVKDIIDGYHKWFINETLHDLHINWSELKVALENNRIEKSDASKKELQRVQKIKREEIYNAFIEHEAFQYLFKENLLSDLLPIQIEQSEDLDAEKKKQAVETFNRFSTYFTGFHENRKNIYSKEGISTSVTYRIVHDNFPKFLENMKVFEILRNECPEVISDTANELAPFIDGVRIEDIFLIDFFNSTFSQNGIDYYNRILGGVTTETGEKYRGINEFTNLYRQQHPEFGKSKKATKMVVLFKQILSDRDTLSFIPEMFGNDKQVQNSIQLFYNREISQFENEGVKTDVCTALATLTSKIAEFDTEKIYIQQPELPNVSQRLFGSWNELNACLFKYAELKFGTAEKVANRKKIDKWLKSDLFSFTELNKALEFSGKDERIENYFSETGIFAQLVKTGFDEAQSILETEYTSEVHLKDQQTDIEKIKTFLDALQNLMHLLKSLCVSEEADRDAAFYNEFDMLYNQLKLVVPLYNKVRNYITQKLFRSDKIKIYFENKGQFLGGWVDSQTENSDNGTQAGGYIFRKENVINEYDYYLGICSDPKLFRRTTIVSENDRSSFERLDYYQLKTASVYGNSYCGKHPYTEDKNELVNSIDRFVHLSGNNILIEKIAKDKVKSNPTTNTPSGYLNFIHREAPNTYECLLQDENFVSLNQRVVSALKATLATLVRVPKALVYAKKDYHLFSEIINDIDELSYEKAFSYFPVSQTEFENSSNRTIKPLLLFKISNKDLSFAENFEKGNRQKIGKKNLHTLYFEALMKGNQDTIDIGTGMVFHRVKSLNYNEKTLKYGHHSTQLNEKFSYPIIKDKRFASDKFLFHLSTEINYKEKRKPLNNSIIEFLTNNPDINIIGLDRGERHLIYLTLINQKGEILRQKTFNIVGNTNYHEKLNQREKERDNARKSWATIGKIKELKEGFLSLVIHEIAKIMVENNAIVVLEDLNFGFKRGRFKVEKQIYQKFEKMLIDKLNYLVFKDKKANEAGGVLKGYQLAEKFESFQKMGKQSGFLFYVPAAYTSKIDPTTGFVNMLNLNYTNMKDAQTLLSGMDKISFNADANYFEFELDYEKFKTNQTDHTNKWTICTVGEKRFTYNSATKETTTVNVTEDLKKLLDKFEVKYSNGDNIKDEICRQTDAKFFEIILWLLKLTMQMRNSNTKTEEDFILSPVKNSNGEFFRSNDDANGIWPADADANGAYHIALKGLYLVKECFNKNEKSLKIEHKNWFKFAQTRFNGSLTKNG

SEQ ID NO: 11 - protein, 1154 aa, Artificial Sequence
  Description of Artificial Sequence: Synthetic polypeptide
MENFKNLYPINKTLRFELRPYGKTLENFKKSGLLEKDAFKANSRRSMQAIIDEKFKETIEERLKYTEFSECDLGNMTSKDKKITDKAATNLKKQVILSFDDEIFNNYLKPDKNIDALFKNDPSNPVISTFKGFTTYFVNFFEIRKHIFKGESSGSMAYRIIDENLTTYLNNIEKIKKLPEELKSQLEGIDQIDKLNNYNEFITQSGITHYNEIIGGISKSENVKIQGINEGINLYCQKNKVKLPRLTPLYKMILSDRVSNSFVLDTIENDTELIEMISDLINKTEISQDVIMSDIQNIFIKYKQLGNLPGISYSSIVNAICSDYDNNFGDGKRKKSYENDRKKHLETNVYSINYISELLTDTDVSSNIKMRYKELEQNYQVCKENFNATNWMNIKNIKQSEKTNLIKDLLDILKSIQRFYDLFDIVDEDKNPSAEFYTWLSKNAEKLDFEFNSVYNKSRNYLTRKQYSDKKIKLNFDSPTLAKGWDANKEIDNSTIIMRKFNNDRGDYDYFLGIWNKSTPANEKIIPLEDNGLFEKMQYKLYPDPSKMLPKQFLSKIWKAKHPTTPEFDKKYKEGRHKKGPDFEKEFLHELIDCFKHGLVNHDEKYQDVFGFNLRNTEDYNSYTEFLEDVERCNYNLSFNKIADTSNLINDGKLYVFQIWSKDFSIDSKGTKNLNTIYFESLFSEENMIEKMFKLSGEAEIFYRPASLNYCEDIIKKGHHHAELKDKFDYPIIKDKRYSQDKFFFHVPMVINYKSEKLNSKSLNNRTNENLGQFTHIIGIDRGERHLIYLTVVDVSTGEIVEQKHLDEIINTDTKGVEHKTHYLNKLEEKSKTRDNERKSWEAIETIKELKEGYISHVINEIQKLQEKYNALIVMENLNYGFKNSRIKVEKQVYQKFETALIKKFNYIIDKKDPETYIHGYQLTNPITTLDKIGNQSGIVLYIPAWNTSKIDPVTGFVNLLYADDLKYKNQEQAKSFIQKIDNIYFENGEFKFDIDFSKWNNRYSISKTKWTLTSYGTRIQTFRNPQKNNKWDSAEYDLTEEFKLILNIDGTLKSQDVETYKKFMSLFKLMLQLRNSVTGTDIDYMISPVTDKTGTHFDSRENIKNLPADADANGAYNIARKGIMAIENIMNGISDPLKISNEDYLKYIQNQQE

SEQ ID NO: 12 - protein, 1307 aa, Artificial Sequence
  Description of Artificial Sequence: Synthetic polypeptide
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 13 - protein, 1129 aa, Artificial Sequence
  Description of Artificial Sequence: Synthetic polypeptide
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 14 - protein, 1108 aa, Artificial Sequence
  Description of Artificial Sequence: Synthetic polypeptide
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 15 - protein, 1149 aa, Artificial Sequence
  Description of Artificial Sequence: Synthetic polypeptide
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 16 - protein, 1252 aa, Artificial Sequence
  Description of Artificial Sequence: Synthetic polypeptide
MTKLRHRQKKLTHDWAGSKKREVLGSNGKLQNPLLMPVKKGQVTEFRKAFSAYARATKGEMTDGRKNMFTHSFEPFKTKPSLHQCELADKAYQSLHSYLPGSLAHFLLSAHALGFRIFSKSGEATAFQASSKIEAYESKLASELACVDLSIQNLTISTLFNALTTSVRGKGEETSADPLIARFYTLLTGKPLSRDTQGPERDLAEVISRKIASSFGTWKEMTANPLQSLQFFEEELHALDANVSLSPAFDVLIKMNDLQGDLKNRTIVFDPDAPVFEYNAEDPADIIIKLTARYAKEAVIKNQNVGNYVKNAITTTNANGLGWLLNKGLSLLPVSTDDELLEFIGVERSHPSCHALIELIAQLEAPELFEKNVFSDTRSEVQGMIDSAVSNHIARLSSSRNSLSMDSEELERLIKSFQIHTPHCSLFIGAQSLSQQLESLPEALQSGVNSADILLGSTQYMLTNSLVEESIATYQRTLNRINYLSGVAGQINGAIKRKAIDGEKIHLPAAWSELISLPFIGQPVIDVESDLAHLKNQYQTLSNEFDTLISALQKNFDLNFNKALLNRTQHFEAMCRSTKKNALSKPEIVSYRDLLARLTSCLYRGSLVLRRAGIEVLKKHKIFESNSELREHVHERKHFVFVSPLDRKAKKLLRLTDSRPDLLHVIDEILQHDNLENKDRESLWLVRSGYLLAGLPDQLSSSFINLPIITQKGDRRLIDLIQYDQINRDAFVMLVTSAFKSNLSGLQYRANKQSFVVTRTLSPYLGSKLVYVPKDKDWLVPSQMFEGRFADILQSDYMVWKDAGRLCVIDTAKHLSNIKKSVFSSEEVLAFLRELPHRTFIQTEVRGLGVNVDGIAFNNGDIPSLKTFSNCVQVKVSRTNTSLVQTLNRWFEGGKVSPPSIQFERAYYKKDDQIHEDAAKRKIRFQMPATELVHASDDAGWTPSYLLGIDPGEYGMGLSLVSINNGEVLDSGFIHINSLINFASKKSNHQTKVVPRQQYKSPYANYLEQSKDSAAGDIAHILDRLIYKLNALPVFEALSGNSQSAADQVWTKVLSFYTWGDNDAQNSIRKQHWFGASHWDIKGMLRQPPTEKKPKPYIAFPGSQVSSYGNSQRCSCCGRNPIEQLREMAKDTSIKELKIRNSEIQLFDGTIKLFNPDPSTVIERRRHNLGPSRIPVADRTFKNISPSSLEFKELITIVSRSIRHSPEFIAKKRGIGSEYFCAYSDCNSSLNSEANAAANVAQKFQKQLFFEL

SEQ ID NO: 17 - protein, 1287 aa, Artificial Sequence
  Description of Artificial Sequence: Synthetic polypeptide
MKRILNSLKVAALRLLFRGKGSELVKTVKYPLVSPVQGAVEELAEAIRHDNLHLFGQKEIVDLMEKDEGTQVYSVVDFWLDTLRLGMFFSPSANALKITLGKFNSDQVSPFRKVLEQSPFFLAGRLKVEPAERILSVEIRKIGKRENRVENYAADVETCFIGQLSSDEKQSIQKLANDIWDSKDHEEQRMLKADFFAIPLIKDPKAVTEEDPENETAGKQKPLELCVCLVPELYTRGFGSIADFLVQRLTLLRDKMSTDTAEDCLEYVGIEEEKGNGMNSLLGTFLKNLQGDGFEQIFQFMLGSYVGWQGKEDVLRERLDLLAEKVKRLPKPKFAGEWSGHRMFLHGQLKSWSSNFFRLFNETRELLESIKSDIQHATMLISYVEEKGGYHPQLLSQYRKLMEQLPALRTKVLDPEIEMTHMSEAVRSYIMIHKSVAGFLPDLLESLDRDKDREFLLSIFPRIPKIDKKTKEIVAWELPGEPEEGYLFTANNLFRNFLENPKHVPRFMAERIPEDWTRLRSAPVWFDGMVKQWQKVVNQLVESPGALYQFNESFLRQRLQAMLTVYKRDLQTEKFLKLLADVCRPLVDFFGLGGNDIIFKSCQDPRKQWQTVIPLSVPADVYTACEGLAIRLRETLGFEWKNLKGHEREDFLRLHQLLGNLLFWIRDAKLVVKLEDWMNNPCVQEYVEARKAIDLPLEIFGFEVPIFLNGYLFSELRQLELLLRRKSVMTSYSVKTTGSPNRLFQLVYLPLNPSDPEKKNSNNFQERLDTPTGLSRRFLDLTLDAFAGKLLTDPVTQELKTMAGFYDHLFGFKLPCKLAAMSNHPGSSSKMVVLAKPKKGVASNIGFEPIPDPAHPVFRVRSSWPELKYLEGLLYLPEDTPLTIELAETSVSCQSVSSVAFDLKNLTTILGRVGEFRVTADQPFKLTPIIPEKEESFIGKTYLGLDAGERSGVGFAIVTVDGDGYEVQRLGVHEDTQLMALQQVASKSLKEPVFQPLRKGTFRQQERIRKSLRGCYWNFYHALMIKYRAKVVHEESVGSSGLVGQWLRAFQKDLKKADVLPKKGGKNGVDKKKRESSAQDTLWGGAFSKKEEQQIAFEVQAAGSSQFCLKCGWWFQLGMREVNRVQESGVVLDWNRSIVTFLIESSGEKVYGFSPQQLEKGFRPDIETFKKMVRDFMRPPMFDRKGRPAAAYERFVLGRRHRRYRFDKVFEERFGRSALFICPRVGCGNFDHSSEQSAVVLALIGYIADKEGMSGKKLVYVRLAELMAEWKLKKLERSRVEEQSSAQ

SEQ ID NO: 18 - protein, 1192 aa, Artificial Sequence
  Description of Artificial Sequence: Synthetic polypeptide
MAESKQMQCRKCGASMKYEVIGLGKKSCRYMCPDCGNHTSARKIQNKKKRDKKYGSASKAQSQRIAVAGALYPDKKVQTIKTYKYPADLNGEVHDSGVAEKIAQAIQEDEIGLLGPSSEYACWIASQKQSEPYSVVDFWFDAVCAGGVFAYSGARLLSTVLQLSGEESVLRAALASSPFVDDINLAQAEKFLAVSRRTGQDKLGKRIGECFAEGRLEALGIKDRMREFVQAIDVAQTAGQRFAAKLKIFGISQMPEAKQWNNDSGLTVCILPDYYVPEENRADQLVVLLRRLREIAYCMGIEDEAGFEHLGIDPGALSNFSNGNPKRGFLGRLLNNDIIALANNMSAMTPYWEGRKGELIERLAWLKHRAEGLYLKEPHFGNSWADHRSRIFSRIAGWLSGCAGKLKIAKDQISGVRTDLFLLKRLLDAVPQSAPSPDFIASISALDRFLEAAESSQDPAEQVRALYAFHLNAPAVRSIANKAVQRSDSQEWLIKELDAVDHLEFNKAFPFFSDTGKKKKKGANSNGAPSEEEYTETESIQQPEDAEQEVNGQEGNGASKNQKKFQRIPRFFGEGSRSEYRILTEAPQYFDMFCNNMRAIFMQLESQPRKAPRDFKCFLQNRLQKLYKQTFLNARSNKCRALLESVLISWGEFYTYGANEKKFRLRHEASERSSDPDYVVQQALEIARRLFLFGFEWRDCSAGERVDLVEIHKKAISFLLAITQAEVSVGSYNWLGNSTVSRYLSVAGTDTLYGTQLEEFLNATVLSQMRGLAIRLSSQELKDGFDVQLESSCQDNLQHLLVYRASRDLAACKRATCPAELDPKILVLPVGAFIASVMKMIERGDEPLAGAYLRHRPHSFGWQIRVRGVAEVGMDQGTALAFQKPTESEPFKIKPFSAQYGPVLWLNSSSYSQSQYLDGFLSQPKNWSMRVLPQAGSVRVEQRVALIWNLQAGKMRLERSGARAFFMPVPFSFRPSGSGDEAVLAPNRYLGLFPHSGGIEYAVVDVLDSAGFKILERGTIAVNGFSQKRGERQEEAHREKQRRGISDIGRKKPVQAEVDAANELHRKYTDVATRLGCRIVVQWAPQPKPGTAPTAQTVYARAVRTEAPRSGNQEDHARMKSSWGYTWGTYWEKRKPEDILGISTQVYWTGGIGESCPAVAVALLGHIRATSTQTEWEKEEVVFGRLKKFFPS

SEQ ID NO: 19 - protein, 986 aa, Artificial Sequence
  Description of Artificial Sequence: Synthetic polypeptide
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTCSNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVHADEQAALNIARSWLFLNSNSTEFKSYKSGKQPFVGAWQAFYKRRLKEVWKPNA

SEQ ID NO: 20 - protein, 973 aa, Artificial Sequence
  Description of Artificial Sequence: Synthetic polypeptide
MKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPAPKNIDQRKLIPVKDGNERLTSSGFACSQCCQPLYVYKLEQVNDKGKPHTNYFGRCNVSEHERLILLSPHKPEANDELVTYSLGKFGQRALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSFPLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKP

SEQ ID NO: 21 - DNA, 4077 bp, Artificial Sequence
  Description of Artificial Sequence: Synthetic polynucleotide
atgggaaaaatgtattatcttggtctggatataggaacaaattctgttggatatgccgtaaccgacccatcgtaccatttgctcaaatttaaaggcgaaccgatgtggggtgcccacgtgtttgctgcggggaatcaatcagctgaacggagaagctttcgtacgagccgcagacgccttgaccgcaggcaacagcgtgtcaaactggttcaagaaatctttgctcccgtgattagtcccattgatccacgtttttttatcagacttcatgagagcgctttatggcgggatgatgtggctgaaacggataaacatattttctttaatgacccgacctatacggataaggaatattattctgactatccaaccatccatcatctcattgtggaccttatggaaagcagtgaaaagcatgacccgcggcttgtttatttggctgttgcctggctggttgctcatcgtggtcatttcctcaatgaagtggataaggataatattggggatgtcctgagttttgacgccttttatcctgagtttctggcatttctttccgataatggggtgtcaccttgggtatgtgagtcaaaagcactccaagcgaccctgctttcacgaaactccgtcaacgataagtataaagccttgaagtctctgatctttggcagccaaaagccggaggataattttgatgccaatatcagtgaagatggacttatccaacttttagcaggaaaaaaggtcaaggtcaataaactttttcctcaagaaagtaatgatgcttcctttacactcaatgataaggaagatgcaattgaggaaatcttaggaacgcttacaccggatgagtgtgaatggattgcgcatattaggaggctgtttgattgggccatcatgaaacatgctctcaaagatggcagaacaatctccgaatcgaaagtaaagctctatgaacagcatcaccatgacttgacacagctcaagtattttgtgaagacctatctagcaaaggaatatgatgacatttttcgaaacgtagatagtgaaacaaccaaaaactatgtcgcatattcctatcatgtaaaagaagtcaagggtacattgcccaaaaataaggcaacccaagaagaattttgcaagtatgtccttggaaaggtaaagaacatcgaatgcagtgaagctgataaggttgattttgatgaaatgattcagcgtcttacagacaattcctttatgccgaaacaagtatcaggtgaaaacagggttatcccttaccagctttactattatgaactaaagactattttgaataaagccgcttcttatctgccttttttgacccaatgcggaaaagatgccatctccaatcaagataagctcctttccatcatgacctttcggattccgtatttcgttgggcccttgcgcaaggacaattcagagcatgcctggctggaacgaaaagcagggaaaatctatccgtggaattttaacgacaaagttgaccttgataaaagtgaagaagcgttcattcggagaatgacgaatacctgcacttattatcccggtgaagatgttttgccacttgactcccttatttatgaaaaattcatgatcctcaatgaaatcaataatatccgaattgatggttatcctatttctgtagatgtaaaacagcaggtttttggcctctttgaaaagaagagaagagtgaccgtaaaggatatccagaatctcctgctttccttgggtgccttggataagcatggtaaattgacgggaatcgatactaccatccatagcaattacaatacataccatcattttaaatcgctcatggagcgtggcgttcttactcgtgatgatgtggaacgcattgtggagcgtatgacctatagtgatgatacaaaacgcgtccgtctttggctgaacaataattatggaacgctcactgctgacgacgtaaagcatatttcaaggctccgaaagcatgattttggccggctttccaaaatgttcctcacaggcctaaagggagttcataaggaaacgggggaacgagcttccattttggattttatgtggaataccaatgataacttgatgcagcttttatctgaatgttatactttttcggatgaaattaccaagctgcaggaagcatactatgccaaggcgcagctttccctgaatgattttctggactccatgtatatttcaaatgctgtcaaacgtcctatctatcgaactcttgccgttgtaaatgacatacgcaaagcctgtgggacggcgccaaaacgcatttttatcgaaatggcaagagatggggaaagcaaaaagaaaaggagcgtaacaagaagagaacaaatcaagaatctttataggtccatccgcaaggattttcagcaggaggtagatttccttgaaaaaatccttgaaaacaaaagcgatggacagctgcaaagcgatgcgctctatctatactttgcgcagcttggaagggatatgtataccggggaccctatcaagttggagcatatcaaggaccagtccttctataatattgatcatatctatccccaaagcatggtcaaggacgatagtcttgataacaaggtgttggttcaatcggaaattaatggagagaagagcagtcgatatcctcttgatgctgctatccgtaataaaatgaagcctctttgggatgcttattataaccatggcctgatttccctcaagaagtatcagcgtttgacgcggagcactccctttacagatgatgaaaagtgggatttcatcaatcggcagcttgttgagacaagacaatccacgaaggccttggcaatcttactaaaaaggaagttccctgatacggagattgtctactccaaggcagggctttcttctgattttcggcatgagtttggtctcgtaaaatcgaggaatatcaatgacctgcaccatgcaaaggacgcatttcttgcgattgtaacaggaaatgtctatcatgaacgctttaatcgccggtggtttatggtgaaccagccctattccgtcaagaccaagacgttgtttacgcattctattaaaaatggtaattttgtagcttggaatggagaagaggatcttggccgcattgttaaaatgttaaagcaaaataagaacactattcatttcacgcggttctcttttgatcgaaaggaaggcctgtttgatattcagccactaaaagcgtcaaccggtcttgtaccaagaaaagccggactagacgtggtaaaatatggtggctatgacaaatcgacagcagcttattatctccttgttcgatttacactagaagataaaaagactcaacataaattgatgatgattcctgtagaaggcttgtataaagctcgaattgaccatgataaggaattcttaacggactatgcacaaactacaatcagtgaaatcctacaaaaagataaacaaaaggtgataaatataatgtttccaatgggaacaaggcacattaaactgaattccatgatttcaatcgatggtttttatctttccattggaggaaagtctagtaagggaaaatcggtgttgtgtcatgctatggtacctcttattgtacctcataagatagaatgttatattaaggcgatggagtcttttgcacgtaaatttaaagaaaataataaattaaggattgtggaaaagtttgataagattacggtggaagataacttgaacctatacgaactatttttacaaaaacttcaacataacccatataataagttcttctccacacaatttgatgtgctgactaatggaagaagtacatttactaaattatctccagaggaacaagttcaaacgttattgaatatcttatcaatttttaaaacttgtcggagctctggctgcgatttaaaatccattaacggttctgctcaagctgccagaattatgatcagcgcagatttaactggactctcaaaaaaatattccgatattcggcttgttgagcaatcagcatctggactttttgttagtaaatcacaaaatcttttggagtatttatga

SEQ ID NO: 22 - DNA, 4005 bp, Artificial Sequence
  Description of Artificial Sequence: Synthetic polynucleotide
atgtcttcattaacaaaatttacaaataaatacagtaagcagctaaccataaaaaatgaactcatcccagtaggaaagactctcgagaacattaaggaaaacggtctcatagatggagatgaacagctaaacgagaattatcaaaaagcaaagataatcgttgatgattttctacgagatttcataaataaagctttaaataatacccaaataggaaattggagagaattagcagatgctttaaataaagaagatgaagataacatagaaaagctccaagacaaaatcagaggaataattgtaagtaaattcgagacatttgatttgttttcttcttactcgataaagaaagacgaaaagataatagatgatgataatgatgttgaagaagaggagctagatctaggaaaaaaaacttcctcatttaaatatatttttaagaaaaacctttttaaattagtacttccttcttatttaaagacaacaaatcaggataaactgaaaataatctcttcttttgataatttttctacctatttcagaggattctttgagaacagaaaaaatattttcactaagaagcctatatctacgtcaattgcctacagaattgtccatgataactttccaaagtttctagataacatcagatgttttaatgtgtggcaaacagaatgcccacagttaattgtaaaggctgataattatttaaaatcaaagaacgtcatagctaaagataaatctttagcaaactattttactgtaggagcatatgattacttcttatcccagaatggcattgatttctacaacaacattatcggcggtctaccagcatttgctggtcatgagaaaatccaaggacttaatgaatttataaatcaagaatgccaaaaggacagcgaactaaaatctaaactgaaaaacagacatgctttcaaaatggctgttctatttaagcaaattctttcagatagagaaaaaagttttgttatagacgagttcgaatctgatgctcaggtcatagatgcggttaagaacttctatgcagaacaatgtaaggataataatgttatttttaaccttctaaatcttatcaagaatatagcgttcttatctgatgatgaattagatggaatttttatagaaggcaagtatttaagctctgtttcccaaaagctatattcagattggtcgaagcttcgaaatgatattgaagatagtgcaaacagtaaacaaggaaataaagagttagcaaagaaaattaaaacaaataaaggcgatgttgaaaaggccataagtaaatatgagttttctttatcagaacttaactcaattgtacatgataatacaaaattcagtgaccttctttcttgtacgttacataaagtggctagcgaaaaactagtgaaagttaatgaaggggactggccaaaacacctgaaaaataatgaagaaaaacaaaagataaaagagcctttagatgcattgttagaaatttataatacattgctgatattcaactgcaagtcatttaataagaacggtaatttctatgttgattatgacagatgcataaatgagctttctagtgttgtttatttatataacaaaacaagaaattactgtacaaagaaaccttataacacagacaaattcaaattaaactttaacagtcctcaattaggagagggctttagtaagtcgaaagaaaatgactgtctgacattattatttaaaaaagacgacaattactatgttggaattatcagaaaaggggcaaaaattaactttgatgatacacaagccattgcagacaatacagataactgtatatttaagatgaattatttcctattaaaagatgctaaaaagtttattcctaaatgttcaattcagttaaaagaagtaaaagcacattttaaaaaatcagaggatgattatatcctgagtgacaaagaaaaatttgcctctccccttgttattaagaaatcaacatttttattagcaacagcacatgtaaaaggaaagaaaggaaacataaaaaaattccaaaaggaatattctaaggaaaatccaacagaatatagaaattctctgaatgaatggattgcattttgtaaagaatttctaaaaacatataaggcggcaacaatctttgacattacaacgttaaaaaaagctgaagaatatgctgatattgttgagttttataaggatgtagataatctttgttataaactagagttttgccctattaaaacatctttcattgagaatcttattgataatggggacttatatttattcagaatcaataataaagatttcagttcaaaatctactggtacaaagaatcttcatacgctctatcttcaggcaatctttgatgaaagaaacctcaataatcctactattatgttaaatggcggagcagagttattttatcgaaaagaaagcattgaacagaaaaataggataactcataaggcaggatcaattcttgtaaacaaggtttgtaaggatggaacaagtctagatgacaaaatcagaaacgaaatatatcaatatgaaaacaagtttattgatacattgtctgatgaagctaaaaaagttttacctaatgtaataaaaaaagaagcaactcacgacataacaaaagataagcgatttacatcagataagttctttttccattgcccattaacaattaactataaggaaggagatacaaaacaatttaacaatgaggttttatctttccttagaggtaatccagacattaatatcatcggaattgacagaggagaaagaaaccttatatacgtaactgttattaatcagaaaggcgaaatacttgacagcgtttcgtttaacacagtaacaaacaagtcgagcaaaattgaacaaactgttgattatgaggaaaagcttgctgttagggaaaaagaaagaatagaagcaaaaagatcctgggattcaatatcaaagatagcaaccttaaaagaaggttatctatcagctattgttcatgagatatgcctactgatgatcaaacacaacgcaatcgttgtacttgagaatctaaatgcaggatttaagagaattagaggaggattatcagaaaagtctgtttatcagaaattcgagaagatgcttattaacaaactaaattactttgtatctaaaaaagaatcagactggaataaacctagtggacttttaaatggtttacaactttcagaccagttcgagtcatttgagaaattaggaattcaatctgggttcatcttctatgttcctgcagcatatacatctaagattgatcctacaacaggatttgcaaatgttcttaacttatccaaggtaagaaatgttgatgcaataaagagttttttcagtaatttcaatgaaatttcatatagcaaaaaagaagctctctttaaattctcttttgatttagattccttatcaaagaagggcttcagctcatttgtaaaattcagtaaatctaaatggaatgtatatacatttggagagagaataataaaaccaaagaataagcaagggtatcgtgaagataagagaattaatttaacatttgaaatgaaaaaacttctgaatgaatataaagtaagttttgatcttgaaaacaacttaattccaaatctaacctctgcaaatctgaaagataccttctggaaagaactattctttatttttaaaacaactctgcagcttagaaacagtgtaacaaatggcaaagaagatgtactgatttctccagtaaagaacgctaaaggagagttctttgtatcaggaactcataacaagacattacctcaagactgtgatgcaaatggagcatatcatatcgccctaaaaggtctgatgattcttgaacgtaacaatcttgttagagaagaaaaagacacaaagaagataatggcaatttctaatgttgactggtttgagtatgttcaaaaaaggagaggtgtcctgtaa

SEQ ID NO: 23 - DNA, 3717 bp, Artificial Sequence
  Description of Artificial Sequence: Synthetic polynucleotide
atgaacaactatgatgagtttaccaaactgtacccaatacagaaaacgataaggttcgaattgaagccgcagggaagaacgatggaacacctcgaaacattcaactttttcgaagaggacagggatagagcggagaaatataagattttaaaggaagcaatcgacgagtatcataagaagtttatagacgaacatctaacaaatatgtctcttgactggaattctttaaaacagatttcagagaaatactataagagtagagaggaaaaagacaagaaagtttttctgtcagaacagaaacgcatgaggcaagagatagtttctgagttcaaaaaagacgatcggtttaaagatcttttttcaaaaaaattgttttctgaacttctcaaggaagagatttacaaaaaaggaaaccatcaggaaattgacgcattgaaaagttttgataaattctcaggctattttattgggttgcatgagaaccgaaaaaatatgtattctgacggagacgagatcacggctatctctaaccgtattgtaaatgagaatttcccgaagttcctcgacaaccttcagaaatatcaggaagctcgtaaaaaatatccagagtggatcattaaggcagaatctgctttagttgcacataatatcaagatggatgaagtcttttccttagagtatttcaacaaagtcctgaatcaagaaggaatacagagatacaatctcgccctaggtggctatgtgaccaaaagtggtgagaaaatgatggggcttaatgatgcacttaatcttgcccatcaaagtgaaaaaagcagcaagggaaggatacacatgactccactcttcaaacagattctgagtgaaaaagagtccttttcttatataccagatgtttttacagaagactctcaacttttaccatccattggtgggttctttgcacaaatagaaaatgataaggacgggaatatttttgacagagcattagaattgatatcttcttatgcagaatacgatacagaaaggatatatatcaggcaagcggacataaacagagtttctaatgttattttcggggagtggggaacactgggggggttaatgagggaatacaaagcagactctatcaacgacatcaatttggagagaacatgcaagaaggtagacaagtggctcgactcaaaggagtttgcgttatcagatgtattagaggcaataaaaagaaccggcaataatgatgcttttaatgaatatatctcaaagatgcgcactgccagggaaaagattgacgctgcaagaaaggaaatgaaattcatttcggaaaaaatatctggagacgaagaatcgatccatattatcaaaaccttattggactcggtgcaacagtttttacattttttcaatttattcaaagcgcgtcaggacattcctcttgatggagcattctatgcggagttcgatgaagtccatagcaaactgtttgctattgttccgttgtataataaggttaggaactatcttacgaaaaataaccttaacacgaaaaagataaagctaaacttcaagaatccaactctggcaaacggatgggatcaaaacaaggtatatgactacgcctccttaatctttctccgcgatggtaattattatctcggaataataaatccaaaaaggaaaaagaatattaaattcgaacaagggtctggaaatggcccattctaccggaagatggtgtacaaacaaattccagggccgaacaagaacttaccaagagtcttcctcacatctacgaaaggcaaaaaagagtacaagccgtcaaaggagataatagaaggatatgaagcggacaaacacataagaggagataaattcgatctggatttctgtcataagctgatagacttcttcaaggaatccatcgagaagcacaaggactggagtaagttcaacttctatttctctccaactgaatcatatggagacatcagcgaattctatctggatgtagaaaaacagggataccggatgcattttgagaatatttctgccgagacgattgatgagtatgtcgaaaagggggacttattcctcttccagatatacaacaaagactttgtgaaagcggcaaccggaaaaaaagatatgcacaccatttattggaacgcggcattctcgcccgagaaccttcaggatgtggtagtgaaactgaacggtgaagcagaacttttctacagagacaagagcgacatcaaggagatagttcacagggagggagagatactggtcaatcgtacctacaacggcaggacacctgtgcctgacaagatccacaaaaaattaacagattatcataatggccgtaccaaagatctcggagaagcaaaagaatacctcgataaggtcagatatttcaaagcgcactacgacatcacaaaggatcgcagatacctgaatgataaaatatacttccatgtgcctctgacattgaatttcaaagcaaacgggaagaagaatctcaataagatggtaattgaaaagttcctctcggacgaaaaagcgcatattattgggattgatcgcggggaaaggaatcttctttactattctatcattgacaggtcaggtaaaataatcgatcaacagagcctcaacgtcatcgatggattcgattaccgagagaaactgaatcagagggagatcgagatgaaggatgccagacaaagctggaatgctatcgggaagataaaggacctcaaggaagggtatctttcaaaagcggtccacgaaattaccaagatggcgatacaatacaatgccattgttgtcatggaggaactcaattatgggttcaaacgcggacgtttcaaagttgagaagcagatatatcagaaattcgagaatatgctgattgacaagatgaattatctggtattcaaggatgctccggatgaaagtccgggaggagtcctcaatgcatatcagcttactaatccgcttgaaagtttcgctaaacttgggaaacagacaggaattcttttctatgttccggcagcctatacttcgaagatagatccgacgaccgggtttgtcaatcttttcaatacttcaagtaaaacgaacgcacaggaaagaaaagaattcttgcaaaaattcgagtcgatctcctattccgctaaagacggaggaatattcgcattcgcgttcgattatcggaagttcggaacgtcaaaaacagaccacaaaaatgtatggaccgcatacacgaacggggaaaggatgaggtacataaaagagaaaaaacgcaacgaactgttcgacccctcgaaggagatcaaagaggctctcacttcatcaggaatcaaatatgacggcggacagaacatattgccagatatcctgaggagcaacaataacggtctgatctacacaatgtattcctctttcatagcggccattcaaatgagggtctatgacgggaaagaagactatatcatctcgccgataaagaacagcaagggagagttcttcaggaccgatccgaaaagaagggaacttccgatagacgcggatgcgaacggcgcgtataacattgctctcaggggcgaattgacgatgcgtgcgatagcggagaagttcgatccggactcggaaaagatggcgaagctagaactgaaacataaggactggttcgaattcatgcagacaaggggggattga

SEQ ID NO: 24 - DNA, 3897 bp, Artificial Sequence
  Description of Artificial Sequence: Synthetic polynucleotide
atgacaaaaacatttgattcagaattttttaatttatattctcttcaaaaaacagttcgttttgaactcaagccggttggtgaaacagcctcgtttgttgaagattttaaaaacgaaggtttgaaacgagttgtttcagaggatgaacggcgtgcggttgattaccaaaaagtgaaagaaattattgatgactaccaccgagattttattgaagaatcgctgaactattttcctgagcaggtctcaaaagacgctttggaacaagcttttcacctttatcaaaaactaaaagccgctaaggttgaagagcgtgaaaaagcattgaaagaatgggaagcccttcagaaaaaactgcgcgaaaaagttgttaaatgtttttcagattcaaacaaagcacgcttttcccgcattgataaaaaagaactgattaaagaagatttaattaactggttggttgcacaaaatcgcgaagatgacattccaaccgttgaaacctttaacaactttacgacttattttacggggtttcatgaaaaccgaaaaaacatttattcaaaagacgatcatgccacagccatttcatttcgactcattcatgaaaacctgcctaagttttttgataatgtgatcagctttaataaattgaaggaaggatttccagagctgaaatttgataaggttaaggaagatttagaagttgattatgacttgaaacatgcctttgaaatcgaatactttgtcaattttgttacccaagccggaattgaccaatataactatcttttggggggtaaaaccttagaagacggcaccaaaaagcaaggcatgaatgaacaaatcaatctgttcaagcaacagcaaacccgagacaaagcccgacaaattcccaaactcataccattgtttaaacaaattctaagcgaacgaacggaaagccaatcgtttattccaaaacaatttgaatcagaccaagagctatttgactcactgcaaaaactgcataacaactgccaagataaatttaccgtactgcaacaagccattttaggcttagccgaagcagatctgaaaaaagtattcattaaaacatctgatcttaatgcgctatcaaataccatttttggaaattacagtgtgttttcggatgcgttgaatttatacaaagaatcgctcaaaacaaaaaaggcgcaagaagcgtttgaaaaactacccgctcacagcattcatgacttgattcaatatttggagcaatttaatagctctttggatgcagaaaaacagcaatcaactgacaccgtactgaattactttattaaaacagacgagctgtattctcggttcataaaatcaacgagcgaagccttcacacaagtacaaccactctttgaattggaagcattaagctcaaaacgtcgtccaccggaaagtgaagacgaaggcgcaaaaggtcaggaagggtttgagcaaattaaacgcataaaagcctatttggataccttgatggaggcggtgcattttgcaaaaccactttatctggtgaaggggcgcaaaatgattgaaggtctggacaaagaccaaagtttctatgaagcctttgaaatggcttaccaagaactagaaagtctgattattccaatctacaacaaagctcgtagttatttaagtcgtaaaccgtttaaagcggacaaattcaaaattaattttgataataatacattgctttccggttgggatgctaataaagaaacggctaacgcttcaattttgtttaagaaggatggtttgtattatttaggaatcatgcctaaaggaaaaacgtttttgttcgattacttcgtttcatcggaagattctgaaaagttaaaacaaagaagacaaaaaaccgccgaagaagcgcttgcgcaagatggcgaaagctactttgaaaaaattcgttacaagctgttacctggcgccagcaaaatgttgccgaaagtatttttttccaacaaaaacatagggttttacaacccaagtgatgacatacttcgtatcaggaatacagcctctcacactaaaaacggaacaccgcaaaaagggcactctaaagtagagtttaatttgaatgattgtcataagatgattgatttctttaaatcaagcattcaaaagcatccagagtggggaagttttggattcaccttttcagatacatcagattttgaagatatgagcgccttttatcgagaagtcgaaaaccaaggttatgtcattagtttcgataaaataaaagaaacttacattcagagtcaagttgaacaggggaacctatatttattccaaatctacaataaagacttctcgccctacagcaaaggcaaaccaaatttacacacgctttactggaaagcgttgtttgaggaagccaacctaaataatgtggtggcaaaactcaatggtgaagctgaaattttctttaggcgacactcaatcaaagcatctgataaagtggtgcacccagcgaatcaagccattgacaataaaaacccgcataccgaaaaaacgcaaagcacctttgaatatgatcttgtaaaagacaagcgctatacccaagacaaattcttcttccatgtaccgatttcattgaactttaaggcacaaggtgtttcaaaatttaacgataaagtgaatggatttttaaagggtaacccagatgtcaatattattggcattgaccgaggcgaacgacaccttctgtatttcactgtggtgaatcagaaaggtgaaattttggttcaagagtcgcttaataccctaatgagtgataaagggcatgtgaatgactaccagcaaaaactcgacaaaaaagaacaagaacgcgatgccgctcgcaaaagctggacgacggttgaaaatatcaaagaattaaaagaaggctatttatctcatgttgttcataagttggcacacctgattattaaatacaatgccattgtttgcttggaagacctgaattttggtttcaaacgcgggcgttttaaagtggaaaaacaagtttatcagaaatttgaaaaagcgcttattgataagcttaactacttggtatttaaagaaaaagagttaggcgaggtgggccattatctaaccgcctatcagttgaccgcaccgtttgaaagtttcaagaagttaggcaagcaaagtggcatattgttttatgttccggcggattacacctccaaaattgacccaaccaccgggtttgtcaactttcttgatctgcgttatcagagtgtcgaaaaagccaaacagctcttaagcgactttaatgccattcgttttaattcagtacaaaactattttgagttcgaaatagattacaaaaaactcacacccaaacgtaaagttggtactcagagtaaatgggtgatttgtacctatggagatgtccgctatcaaaatcggcgtaatcaaaaaggtcactgggaaacggaagaagtcaatgtgactgaaaaactaaaagcccttttcgccagtgattccaaaactacaaccgtaatcgattacgccaatgacgacaacctaattgacgtcattctggaacaggacaaagccagcttcttcaaagaactgttatggttattaaaactcaccatgacgctccgccacagcaaaatcaaaagtgaagacgactttattctttcacccgttaaaaacgaacaaggcgagttttacgatagtcgaaaagcgggcgaggtgtggcctaaagatgcagacgccaatggcgcttatcacatagcgttgaaaggcttgtggaatctgcaacagatcaatcagtgggaaaagggtaaaacacttaatctggcgattaaaaaccaggattggttcagttttattcaagaaaagccctatcaagaataa

SEQ ID NO: 25 - DNA, 3708 bp, Artificial Sequence
  Description of Artificial Sequence: Synthetic polynucleotide
atgcacacaggcggattacttagcatggatgccaaggagtttaccggacagtaccccctttcgaagactctgcgttttgaactgagaccgataggcagaacgtgggacaatctcgaagcatcggggtatcttgcggaggacagacaccgtgcagaatgctatcccagggcaaaagagctcttggacgacaaccatcgtgcattcctcaaccgtgtcctgcctcagatcgatatggattggcacccgatcgcagaggcattctgcaaagtccacaagaatccgggaaacaaggaattggctcaggattacaatcttcagctgtccaaacgcagaaaggagatttcggcctatctgcaggatgcggacggctataaaggtctgtttgccaaacctgcattggatgaagcaatgaagatcgcgaaagaaaacggaaatgaatcggacatagaggttcttgaggcattcaacggtttctccgtatacttcaccggatatcatgagagcagggagaacatctattcggacgaggatatggtgtcggtagcttatcgcatcaccgaagacaatttcccgagattcgtttccaatgcgcttatattcgataagctgaatgagtcgcaccccgatataatctcggaagtatccggaaatctgggcgtagacgacatcggaaaatattttgatgtgtctaactacaataatttcctgtcgcaggccggtatagatgactacaatcacatcatcggcggccatacgacggaggacggtctgatccaggcattcaatgttgttctgaatctcaggcatcagaaagaccccggattcgaaaaaatccaattcaaacagctgtacaaacagatactcagcgtccgtacatccaaatcctatatcccgaaacagttcgataattcgaaggagatggtggactgcatctgcgactatgtgtccaagatcgaaaaatccgaaacggtcgagagagcattgaagctggtaaggaacatatcttcttttgatttgcgcggaatattcgtaaacaagaagaatctccgcattctttccaacaaactgattggtgattgggacgcgatcgaaaccgcgctgatgcactcctcctcttcggaaaatgataagaaatccgtctacgacagcgccgaggcatttacgctggatgatatcttttcgtccgttaaaaaattctcagatgcatctgcagaggatatcggaaaccgggcggaggacatatgcagagtcatatctgagaccgctccgttcataaacgatctgagggctgtcgatttggacagtttgaatgacgacggttacgaggcggcggtttccaagataagggaatctctggaaccatatatggatctgtttcatgaactggagatattctccgtaggcgatgaattcccgaaatgtgcagctttctacagtgaacttgaagaagtctccgaacagctaatcgagattataccgttattcaacaaggcccgttcgttctgtacgcgcaagagatacagtacggacaagataaaggtcaatttgaaattcccgacactcgccgacggatgggatctcaacaaagaacgcgacaacaaagccgcaatactcaggaaagacggaaagtactacctggccatactggatatgaagaaagatctttcttcgatcagaacttcggatgaagacgaatccagttttgagaaaatggagtacaagcttcttccgagtccggtaaagatgctgccaaagatcttcgtaaaatcgaaggcggccaaggagaagtacggtctgaccgaccgtatgctggagtgctacgataaagggatgcacaagagcggcagtgcattcgatctcggattttgtcacgaattgatcgattactacaagaggtgcatcgcagaatatcccggctgggacgtcttcgatttcaagttcagggaaacatcggattatggcagcatgaaggagttcaatgaggatgttgcaggggccggatactatatgtccctcagaaagatcccttgttcggaggtctacaggcttcttgatgagaaatcgatatatcttttccagatctacaacaaagattattcggaaaacgctcatgggaataagaacatgcataccatgtattgggaagggctcttttccccccagaatctggaatcccctgtgtttaaactcagcggcggtgcggagcttttcttccgtaaatcctccatacccaatgacgccaaaacggtccatccgaagggaagcgtcctggttccgcgcaatgatgtaaacggccgcaggatacctgacagcatatatcgggagctcaccagatatttcaaccgcggagattgccgcataagcgacgaggcaaagagttatctggacaaggtgaaaaccaagaaagctgaccacgatatcgtgaaagacaggaggttcacggtggacaagatgatgttccacgtccctatcgccatgaatttcaaagcgatttcgaagccgaatctcaataaaaaggtgattgacggcataatcgacgaccaagatctgaagatcatcggcatagaccgcggagagcgcaacctcatctacgtaaccatggtggatcgcaaagggaacatcctctatcaggatagcctcaatattctgaacggatacgattaccgtaaggccctcgacgtccgcgaatatgacaataaagaggctcggaggaactggacgaaggtcgaaggcatccgtaagatgaaagaggggtatctgtcgcttgcagtcagcaaattggcagatatgatcatagagaacaatgcgattatcgtcatggaggatctcaatcacggattcaaggcagggcgttcgaagatagagaaacaggtctatcagaagttcgaatccatgctcataaacaaactcggttacatggtcctcaaggataagtctatcgatcagagcggcggagctctccacggataccagcttgccaaccatgtgacaacattggcatctgtaggtaaacaatgtggagtgatattctacatccctgctgcatttacatccaagatagatccgacaacaggatttgcagatctgttcgccctcagcaatgttaaaaacgtggcatctatgagagaatttttctccaagatgaagtctgtaatctatgataaggcggagggaaaattcgcatttaccttcgactatcttgattataatgtgaaatccgagtgcggaaggaccctttggaccgtgtatacggtcggagagagattcacatacagcagggtcaatagagaatatgtcagaaaagttccgacagacataatctacgacgcattgcaaaaggcaggaatatctgttgaaggggatctcagggacaggattgctgaatcggatggcgacactctgaagagcatattctatgcattcaagtatgcattggatatgagagtagagaaccgcgaagaggattacatacagtctcctgtcaaaaatgcctccggagaattcttctgttccaagaacgcaggcaaatcgctccctcaggattccgatgcgaacggtgcatacaatatcgcactcaaggggatcctgcagctacgtatgctttccgagcagtatgatccgaatgcagagagcatacggttgccactgataaccaacaaggcctggctgacctttatgcagtccggtatgaagacatggaagaactga

SEQ ID NO: 26 - DNA, 3783 bp, Artificial Sequence
  Description of Artificial Sequence: Synthetic polynucleotide
atggatagtttgaaagatttcaccaatctgtaccctgtcagtaagacattgagatttgaattaaagcccgttggaaagactttagaaaatatcgagaaagcaggtattttgaaagaggatgagcatcgtgcagaaagttatcggagggtgaagaaaataattgatacttatcataaggtatttatcgattcttctcttgaaaatatggctaaaatgggtattgagaatgaaataaaagcaatgctccaaagtttctgcgaattgtataaaaaagatcatcgcactgagggtgaagacaaggcattagataaaattcgagcagtacttcgtggcctgattgttggggctttcactggtgtttgcggaagacgggaaaatacagtccaaaacgagaagtacgagagtttgttcaaagaaaagttgataaaagaaattttacctgattttgtgctctctactgaggctgaaagcttgcctttctctgttgaagaagctacgaggtcactgaaggagtttgatagctttacatcctactttgctggtttttacgagaatagaaagaatatatactcgacgaaacctcaatccactgccattgcttatcgtcttattcatgagaacttgccgaagttcattgataatattcttgtttttcagaagatcaaagagcctatagccaaagagctggaacatattcgtgcggacttttctgccggggggtacataaaaaaggatgagagattggaggatattttttcgttgaactattatatccacgtgttatctcaggctgggatcgaaaaatataacgcattgattgggaagattgtgacagaaggagatggagagatgaaagggctcaatgaacacatcaacctttacaaccaacaaagaggcagagaggatcggctccctctttttaggcctctttataaacagatattgagtgacagagagcaattatcatacttgcctgagagttttgaaaaagatgaggagctcctcagggctctaaaagagttctatgatcatatcgcagaagacattctcggacgtactcaacagttgatgacttctatttcagaatatgatttatctcggatatacgtaaggaacgatagccaattgactgatatatcaaaaaaaatgttgggagattggaatgctatctacatggctagagaacgagcatatgaccacgagcaggctcccaaaagaatcacggcgaaatacgagagggacaggattaaagctcttaaaggagaagagagtataagtctggcaaatcttaatagttgtattgcctttctggacaatgttagagattgccgtgtagatacttatctttccacactgggccagaaggaaggaccacatggtctatctaatctcgttgagaacgtttttgcctcataccatgaagcagagcaattgttgagctttccataccccgaagagaataatctgattcaggacaaggacaatgtggtgttaattaagaatcttctcgacaatatcagtgatctgcagaggttcttgaaacctctttggggtatgggagacgaacccgataaagatgaaagattttatggagagtataattatatccgaggagctctagatcaggtgatccctctgtacaataaggtaaggaactacctcactcggaagccttattcgaccagaaaagtaaaactcaattttgggaattctcaattgcttagtggttgggatagaaataaggaaaaggataatagctgtgtgattttgcgtaaggggcagaacttctatttggctattatgaacaataggcacaaaagaagtttcgaaaacaaggtgttgcccgagtataaggagggagaaccttacttcgaaaagatggattataaatttttgcctgatcctaataaaatgcttcctaaggtttttctttcgaaaaaaggaatagagatatacaaaccaagtccgaagcttttagaacaatatggacatggaactcacaaaaagggagatacctttagtatggatgatttgcacgaactgatcgatttcttcaaacactcaatcgaggctcatgaagattggaagcaattcggattcaaattttctgatacggctacttatgagaatgtatctagtttctatagagaagttgaggatcaggggtataagctctctttccgaaaagtttcggaatcttatgtctattcattaatagatcaaggcaagttgtatttatttcagatatacaacaaggacttttctccctgcagcaaagggacacctaatctgcataccttgtattggagaatgctttttgacgagcgcaatttggcagatgtcatatacaaactggatgggaaggctgaaatctttttccgagagaagagtttgaaaaatgatcatcccacgcatccggctggtaagcctatcaaaaagaaaagtcgacaaaaaaaaggagaggagagtctgtttgagtatgatttagtcaaggataggcactatacgatggataagttccagtttcatgtgcctattactatgaattttaaatgttctgcaggaagcaaagtcaatgatatggttaatgctcatattcgagaggcaaaggatatgcatgtcattggaattgatcgtggagaacgcaatctgctgtatatatgcgtgatagatagtcgagggacgattttggatcaaatttctctgaatacgattaacgatatagactatcatgatttattggagagtcgagacaaagaccgtcagcaggagcgccgaaactggcaaactatcgaagggatcaaggagctaaaacaaggctaccttagtcaggcggttcatcggatagccgaactgatggtggcttataaggctgtagttgctttggaggatttgaatatggggttcaaacgtgggcggcagaaagtagaaagttctgtttatcagcagtttgagaaacagctgatagataagctcaactatcttgtggacaagaagaaaaggcctgaagatattggaggattgttgagagcctatcaatttacggccccatttaagagttttaaggaaatgggaaagcaaaacggcttcttgttttatatcccggcttggaacacgagcaacatagatccgactactggatttgttaatttatttcatgcccagtatgaaaatgtagataaagcgaagagcttctttcaaaagtttgattcaattagttacaacccgaagaaagactggtttgagtttgcattcgattataaaaactttactaaaaaggctgaaggaagtcgttctatgtggatattatgcacacatggttcccgaataaagaattttagaaattcccagaagaatggtcaatgggattccgaagaattcgccttgacggaggcttttaagtctctttttgtgcgatatgagatagattataccgctgatttgaaaacagctattgtggacgaaaagcaaaaagacttcttcgtggatcttctgaagctattcaaattgacagtacagatgcgcaacagctggaaagagaaggatttggattatctaatctctcctgtagcaggggctgatggccgtttcttcgatacaagagagggaaataaaagtctgcctaaggatgcagatgccaatggagcttataatattgccctaaaaggactttgggctctacgccagattcggcaaacttcagaaggcggtaaactcaaattggcgatttccaataaggaatggctacagtttgtgcaagagagatcttacgagaaagactga

SEQ ID NO: 27 - DNA, 3792 bp, Artificial Sequence
  Description of Artificial Sequence: Synthetic polynucleotide
atgaataatggaacaaataactttcagaattttatcggaatttcttctttgcagaagactcttaggaatgctctcattccaaccgaaacaacacagcaatttattgttaaaaacggaataattaaagaagatgagctaagaggagaaaatcgtcagatacttaaagatatcatggatgattattacagaggtttcatttcagaaactttatcgtcaattgatgatattgactggacttctttatttgagaaaatggaaattcagttaaaaaatggagataacaaagacactcttataaaagaacagactgaataccgtaaggcaattcataaaaaatttgcaaatgatgatagatttaaaaatatgttcagtgcaaaattaatctcagatattcttcctgaatttgtcattcataacaataattattctgcatcagaaaaggaagaaaaaacacaggtaattaaattattttccagatttgcaacgtcattcaaggactattttaaaaacagggctaattgtttttcggctgatgatatatcttcatcttcttgtcatagaatagttaatgataatgcagagatattttttagtaatgcattggtgtataggagaattgtaaaaagtctttcaaatgatgatataaataaaatatccggagatatgaaggattcattaaaggaaatgtctctggaagaaatttattcttatgaaaaatatggggaatttattacacaggaaggtatatctttttataatgatatatgtggtaaagtaaattcatttatgaatttatattgccagaaaaataaagaaaacaaaaatctctataagctgcaaaagcttcataaacagatactgtgcatagcagatacttcttatgaggtgccgtataaatttgaatcagatgaagaggtttatcaatcagtgaatggatttttggacaatattagttcgaaacatatcgttgaaagattgcgtaagattggagacaactataacggctacaatcttgataagatttatattgttagtaaattctatgaatcagtttcacaaaagacatatagagattgggaaacaataaatactgcattagaaattcattacaacaatatattacccggaaatggtaaatctaaagctgacaaggtaaaaaaagcggtaaagaatgatctgcaaaaaagcattactgaaatcaatgagcttgttagcaattataaattatgttcggatgataatattaaagctgagacatatatacatgaaatatcacatattttgaataattttgaagcacaggagcttaagtataatcctgaaattcatctggtggaaagtgaattgaaagcatctgaattaaaaaatgttctcgatgtaataatgaatgcttttcattggtgttcggttttcatgacagaggagctggtagataaagataataatttttatgccgagttagaagagatatatgacgaaatatatccggtaatttcattgtataatcttgtgcgtaattatgtaacgcagaagccatatagtacaaaaaaaattaaattgaattttggtattcctacactagcggatggatggagtaaaagtaaagaatatagtaataatgcaattattctcatgcgtgataatttgtactatttaggaatatttaatgcaaaaaataagcctgacaaaaagataattgaaggtaatacatcagaaaataaaggggattataagaagatgatttataatcttctgccaggaccaaataaaatgatccccaaggtattcctctcttcaaaaaccggagtggaaacatataagccgtctgcctatatattggagggctataaacaaaacaagcatattaaatcctctaaggattttgatataacattttgtcacgatttgattgattattttaagaactgtatagcaatacatcctgaatggaagaattttggctttgatttttctgacacctccacatatgaagatatcagcggattttacagagaagtcgaattacaaggttataaaatcgactggacatatatcagcgaaaaggatattgatttgttgcaggaaaaaggacagttatatttattccaaatatataacaaagatttttccaagaaaagtaccggaaatgataatcttcatactatgtatttgaagaatttgtttagtgaagagaatttaaaggatattgtactgaaattaaacggtgaggcggaaatcttctttagaaaatcaagcataaagaatccaataattcataaaaaaggctctattcttgttaatagaacatatgaagcagaggaaaaagatcaatttggaaatatccagatagtcagaaaaaacataccggaaaatatatatcaggagctttataaatatttcaatgataaaagtgataaagaactttcggatgaagcagctaagcttaagaatgtagtaggtcatcatgaggctgctacaaacatagtaaaagattatagatatacatatgataaatattttcttcatatgcctattacaatcaattttaaagccaataagacaggctttattaatgacagaatattacaatatattgctaaagaaaaggatttgcatgtaataggcattgatcgtggtgaaagaaacctgatatatgtttcagtaattgatacttgtggaaatattgttgaacaaaaatcgtttaacattgttaatggatatgattatcagattaagctcaagcagcaggagggggcgcgacaaatcgcacgaaaagaatggaaagaaatcggcaaaataaaagaaattaaagaaggctatttatctcttgtaattcatgaaatttcaaagatggttattaaatataatgccataattgcaatggaggatttaagctacggatttaaaaaaggtcgtttcaaggttgagcgacaggtttaccagaagtttgagacaatgcttatcaacaaactcaactatctggtatttaaagatatatccataacggaaaacggtggtcttctaaagggataccagcttacatatattccagataaactgaaaaatgtgggtcatcaatgtggctgtatattttatgtacctgctgcctatacatcaaaaatagatcctacaaccggatttgtaaatatattcaaatttaaagatttaacagttgatgcgaagagagaatttataaaaaaatttgacagtatcagatatgattcagaaaaaaatctgttttgttttacattcgattataataactttattacgcaaaatactgttatgtcaaagtcaagctggagtgtatatacgtacggagttaggataaaaagaagatttgtcaatggcaggttctcaaatgaatcggatacaattgatataacaaaagatatggaaaaaacactcgaaatgacagatataaattggagagatggtcatgatctgaggcaggatattattgattatgaaatcgtacaacacatatttgagatttttagattgactgtacaaatgagaaacagtttaagtgaattagaagacagggattatgaccgtttgatttctccggtgctcaatgaaaataatatattttatgattcagctaaagcaggagatgcgttacctaaagacgcagatgctaatggtgcatattgtatagctctaaaaggcttgtatgaaatcaaacaaattacagagaattggaaagaagacggtaagttttcaagagataaacttaaaatttccaataaggactggtttgactttattcaaaataaaaggtatttataa

SEQ ID NO: 28 - DNA, 3957 bp, Artificial Sequence
  Description of Artificial Sequence: Synthetic polynucleotide
atgacaaacaaatttacaaaccagtactcgctttccaaaacacttcgatttgagttgattccacaaggaaaaacattggaatttattcaagaaaaaggattgctctctcaagataaacaacgagcggagagttatcaagaaatgaaaaaaactattgataaatttcataaatactttatcgatttagctttaagcaatgctaaactaactcatttagaaacttacttggaattatacaataaaagtgctgaaacaaaaaaagaacaaaaatttaaagacgatttaaagaaagtacaagacaatttacgaaaagaaatcgttaaatctttttcagatggtgatgcaaaatcaatttttgcaattttggataaaaaagaactgattaccgtagaacttgaaaaatggtttgaaaacaacgaacaaaaagacatttattttgacgaaaaattcaaaacgtttactacttattttactggttttcatcaaaacagaaaaaacatgtattcggttgaacccaattctacagcaattgcttatcgattgattcatgaaaatttacctaaatttttagaaaatgctaaagcatttgaaaaaataaaacaagtagaaagtttgcaagttaattttagagaattaatgggggaatttggagatgaagggctaattttcgtaaatgaattagaagaaatgtttcaaatcaattattataatgatgtgctttcacaaaatggaattacaatttataatagtataatttcaggatttaccaaaaatgatataaaatataaaggtctaaatgaatacataaataattacaatcaaaccaaagacaaaaaagaccgtttgccaaaattaaaacaattgtataaacagattttgagtgataggatttcactttcgtttttgcccgatgcttttacggatgggaaacaagttttgaaagccatatttgacttttataaaatcaacttactttcttataccattgaaggacaggaagaaagccaaaatcttttactattaattcgtcagacaattgaaaacctttctagttttgatacccaaaaaatttatctaaaaaatgatacccatttaaccactatttcacaacaagtatttggcgatttttcggtgttttcaactgctttaaattattggtatgaaactaaagtaaatccaaaatttgaaacggaatatagcaaagccaacgaaaaaaaacgagaaattttagataaagccaaagcggtatttacaaaacaagattatttttcaattgcttttttacaagaagtactttcggaatacattcttaccttagatcacacttctgatattgtaaaaaagcattcctccaactgtattgcggattattttaaaaatcattttgtagccaaaaaagaaaatgaaaccgacaaaacctttgattttattgctaatattactgcaaaataccaatgtattcaaggtattttagaaaatgcagaccaatacgaagacgaactcaaacaagaccaaaaattaattgataatttgaaattctttttagatgctattttagaattgttgcattttattaaacctttgcatttaaaatcagaaagcattaccgaaaaagacactgctttttatgatgtgtttgaaaattattacgaagcattgagtttgttgaccccattatataatatggtgcgaaactatgtaacgcaaaagccgtacagcaccgaaaaaataaaattaaattttgaaaatgcacaattattgaatggttgggatgccaataaagaaggtgattacctaactaccattttgaaaaaagacggtaattattttttagccataatggataaaaagcataacaaagcgtttcaaaagtttccagaaggaaaagaaaattatgaaaaaatggtgtataaactattgcctggagtaaataagatgttgccaaaagtatttttttccaataaaaatattgcttacttcaacccatcaaaagagttattagaaaactataaaaaagagacgcacaaaaaaggagacacattcaatttagaacattgtcatacgttgatcgattttttcaaggactctttaaacaaacatgaagactggaaatactttgattttcaattttctgaaacaaaatcgtatcaagatttgagtggtttttatagagaagtagaacatcaaggctacaaaatcaattttaaaaatatcgattcagaatatattgatggtttggtgaacgaaggtaaattgtttctatttcaaatttacagcaaagatttttcgcctttttccaaagggaaaccgaacatgcacactttgtattggaaagccttatttgaagaacaaaatttgcaaaatgtaatctataaattgaatggacaagccgaaatattttttagaaaagcctctataaaacctaaaaatataatattgcacaaaaagaaaattaaaattgccaaaaagcattttattgataaaaaaacaaaaacatctgaaattgttcctgttcaaacaataaaaaacctcaatatgtactaccaaggaaaaataagtgaaaaagaattaacacaagatgatttaaggtatattgataattttagcattttcaatgaaaaaaataaaacaattgatattataaaagacaaacgatttacggttgataaatttcagtttcatgtgccgattaccatgaactttaaagcaacgggcggaagttatatcaatcaaaccgtattagaatatttgcaaaacaatcccgaagttaagattattggattggatagaggcgaacgccatttggtatatctgacactgatagaccagcaaggaaacatcttgaaacaagaaagtttgaatacaatcaccgattctaaaatctcgacaccttatcataagttgttggataacaaggaaaacgagcgtgacttggctcgaaaaaattggggaacggtggaaaacatcaaagaactcaaagaaggctacatcagtcaagtggtgcataaaattgctacgttgatgctggaagaaaatgccattgtggtaatggaagatttgaattttggatttaaacgtggacgttttaaagtggaaaaacaaatttatcaaaagctggaaaaaatgttgattgacaaattgaattatttggttttaaaagacaaacaacctcaggaattaggcggattgtacaacgcattacaactcaccaataaatttgaaagtttccaaaaaatgggtaaacaatcgggctttttgttttatgtacccgcttggaacacctccaaaatagacccaaccacagggtttgtcaattatttttataccaaatatgaaaatgttgacaaagccaaagccttttttgaaaaatttgaggcgattcgtttcaatgcagaaaagaagtattttgaatttgaagtaaaaaaatatagcgattttaacccaaaagccgaaggcactcaacaagcctggaccatttgcacgtatggcgaacgaatagaaaccaaacgacaaaaagaccaaaacaacaaatttgtaagcactccaattaatctaaccgaaaagatagaagactttttgggtaaaaaccaaattgtttatggtgatggtaattgcatcaaatctcaaattgctagcaaagacgacaaggctttttttgaaaccttattgtattggttcaaaatgactttacaaatgcgaaacagcgaaacaagaacagatatagattatctaatttcgcccgtgatgaatgacaacggaacattttacaacagccgagattatgaaaaattagaaaatccaactttgcccaaagatgccgatgccaacggagcgtatcatattgccaaaaaaggattgatgcttttgaataaaatagaccaagccgacttgacaaaaaaagtggatttatctattagtaacagagattggttgcaatttgtacaaaaaaataaataa

SEQ ID NO: 29 - DNA, 4019 bp, Artificial Sequence
  Description of Artificial Sequence: Synthetic polynucleotide
atggaacaggagtactatttaggactggatatgggaaccggatctgtaggatgggctgttacagattcggaatatcatgtcttgcgtaaacatggaaaagcactatggggagtccgattatttgaaagtgcatcgacagcagaagaacgaagaatgttccgaacatcaagaagaagactagatcgaagaaactggagaattgaaattttacaggaaatttttgcagaggaaataagtaagaaagatccaggatttttcttgcgaatgaaagaaagcaaatattatccagaagataagcgagatatcaatggaaattgtccggaactgccatatgcattatttgttgatgacgattttacagataaagattatcataaaaaatttccgacaatttatcatctcaggaaaatgttgatgaatacagaggagacaccggatatccggttggtgtatctggcaattcatcatatgatgaagcataggggccatttcttgttatctggtgacattaatgagattaaggagttcggaacgacattttcaaaattgttggagaatatcaaaaatgaggaattggattggaatcttgaactgggaaaagaagaatatgctgttgtagaaagtattttaaaagataacatgttaaaccgatccacaaagaaaaccagattaataaaagcattaaaagcaaaatcaatatgtgaaaaggctgtactgaatttattggctggtggaacggtgaaattgagtgatatatttggtcttgaagaattaaatgagacagaaagaccgaagatttcctttgctgataatggatacgatgattatatcggagaagttgaaaatgagctgggagaacaattctatattatagagacggcaaaagcagtgtatgactgggcggtattagttgaaatattgggaaaatatacgtcaatttcagaagcgaaagtagcaacgtatgaaaaacataaatcggatttacaatttttgaaaaagatagttcggaaatatctgacaaaggaggaatataaagatatttttgtaagtacgagtgacaaattgaaaaattactctgcttatataggaatgacgaaaataaatggaaaaaaggttgatttgcagagcaaacggtgcagtaaagaagaattctatgattttattaagaaaaacgtacttaaaaagctagaaggacaacctgaatatgaatatttgaaagaagagctagaaagagaaacatttctaccaaaacaggtgaacagggataatggtgtaataccgtatcagattcatttgtacgagttgaaaaagatattaggaaatttacgggataaaatagacctcattaaagagaacgaagataaactggttcaattatttgaattcagaattccgtattatgttggtccgctgaataagatagatgacggaaaagagggaaaatttacatgggctgtacggaaaagtaatgaaaagatatatccatggaattttgaaaatgtagttgatatagaagcaagtgcagaaaaatttatccggagaatgacaaataagtgtacatatctgatgggcgaagatgtattgccgaaggattcattgctttacagtaaatatatggttttaaatgaattaaataatgtaaagttggatggcgaaaaattatctgtagaattgaaacaacggttgtatacagatgtattttgtaagtatcggaaagtaactgtaaagaagataaaaaattacttgaaatgtgaaggtatcatatccggcaatgtcgaaataactggaattgatggtgattttaaggcatcgttaacggcatatcatgattttaaagaaatcttgacaggaacagaattggctaaaaaggacaaagaaaatattattaccaatatagtattgtttggagatgataaaaagctgctgaaaaagagactgaatcgattatatcctcagattacgccgaatcagttgaagaaaatatgtgcgctatcctatacaggctggggaagattttctaaaaagttcttagaagaaataacagctccagatccggaaacgggagaggtatggaatatcattacggcattgtgggaatcgaataataatctgatgcaattattaagtaatgaatatcggtttatggaagaagtcgaaacatacaatatgggaaaacagactaaaacattgtcgtacgaaacagtagagaatatgtatgtttctccatctgtgaaaagacagatatggcagacgctgaaaatcgtgaaagaattagaaaaagtaatgaaagaatctccgaaacgtgtatttattgagatggcgagagaaaagcaagaaagtaagagaaccgaatcgcgtaaaaaacaactaatagatttgtataaggcttgtaaaaatgaagaaaaagattgggtaaaagaactgggagatcaggaagaacagaaattacgaagcgataagttgtacctatattatacgcaaaagggtcgttgtatgtattctggcgaggtaatagaactgaaagacttatgggataatacaaaatatgatattgatcatatatatccacaatctaaaacgatggatgacagtcttaataatcgcgtattggtaaaaaagaaatataatgcaacaaaatcagataagtatccattaaatgaaaatatacgacatgagagaaaaggcttttggaagtcactgttagatggagggtttataagtaaagaaaaatatgaacgcttaataagaaatacagaattgagtccggaagaattagcaggatttattgaaaggcagattgttgaaacgaggcagagtacaaaagctgtagcggaaatattaaagcaagtgtttccggaaagtgaaattgtatatgtcaaagcaggtacggtttcaagattcagaaaagattttgaattactgaaagttcgagaagtgaatgatttgcatcacgcaaaggatgcgtatttaaatattgtagttggtaatagttattatgtgaaatttactaagaatgcatcatggtttataaaagaaaatccgggacgtacttacaacttaaaaaagatgtttacatcaggttggaatattgaacgaaatggagaagttgcatgggaagtcgggaaaaaaggaacaattgtaacggtaaaacaaataatgaataaaaataatatattggtgacaagacaggttcatgaagcgaaaggtgggctgtttgatcagcagattatgaaaaaaggaaaaggtcagattgctataaaggaaactgatgaacgtcttgcatcaatagaaaagtatggaggctataataaagctgccggggcatattttatgctggtagaatctaaagataaaaaaggaaaaacaattcgaacgatagaatttataccattatatttaaagaataaaatcgagtcggatgaatcaatagcattgaactttttagaaaaaggcagaggtttgaaagaaccaaagatactattgaaaaaaattaagattgatacattatttgatgtggacggattcaaaatgtggttgtctggaagaacaggggacagactactatttaaatgtgcaaatcaattgattttggatgagaaaataattgtaacaatgaaaaaaattgtaaagtttattcaaaggagacaagaaaatagagaattaaaattatctgataaagatggaattgataatgaagtacttatggaaatatataacacttttgtggataagttagaaaacacagtgtatagaatacgattatccgaacaggcaaaaacgcttatagataaacaaaaagaatttgaaaggttatcactagaggataaaagtagtactttgtttgaaattttacatatttttcagtgtcaaagtagtgcggccaatttaaaaatgataggcggacctggaaaagcaggaatattagttatgaataataatataagtaagtgtaacaaaatttctattataaatcagtctccaacaggaattttcgaaaatgagattgatttgttaaagat

SEQ ID NO: 30 - DNA, 3858 bp, Artificial Sequence
  Description of Artificial Sequence: Synthetic polynucleotide
atgaaatctttcgattcattcacaaatctttattctctttcaaaaaccttgaaatttgagatgagacctgtcggaaatacccaaaaaatgctcgacaatgcaggagtatttgaaaaagacaaactaattcaaaaaaagtacggaaaaacaaagccgtatttcgacagactccacagagaatttatagaagaagcgctcacgggggtagagctaataggactagatgagaactttaggacacttgttgactggcaaaaagataagaaaaataatgtcgcaatgaaagcgtatgaaaatagtttgcagcggctgagaacggaaataggtaaaatatttaacctaaaggctgaggattgggtaaagaacaaatatccaatattagggctgaaaaataaaaataccgatattttattcgaagaggctgtattcgggatattgaaagcccgatatggagaagaaaaagatacttttatagaagtagaggaaatagataaaaccggcaaatcaaagatcaatcaaatatcaattttcgatagttggaaaggatttacaggatatttcaaaaaattttttgaaaccagaaagaatttttacaaaaacgacggaacttctacagcaattgctacaaggatcattgatcaaaatctgaaaagattcatagataatctgtcaatagttgaaagtgtgagacaaaaggttgatctcgccgagacagaaaaatctttcagcatatctctatcgcaattcttctcaatagacttttataacaagtgtctccttcaagatggtattgattactacaacaagataatcggtggagaaactctcaaaaatggcgaaaaactaataggtctcaatgaactaataaatcaatataggcagaataataaggatcagaaaatcccatttttcaaacttcttgataaacaaattttgagtgaaaagatattatttttggatgaaataaaaaatgacacagaactgatcgaggcgctgagtcagttcgcaaaaacagccgaagaaaaaacaaaaattgtcaaaaagctttttgccgattttgtagaaaataattccaaatacgatcttgcacagatttatatttcccaagaagcattcaatactatatcaaacaagtggacaagcgaaactgagacgttcgctaaatatctattcgaagcaatgaagagtggaaaacttgcaaagtatgagaaaaaagataatagctataaatttcctgattttattgccctttcacagatgaagagtgctttattaagtatcagccttgagggacatttttggaaagagaaatactacaaaatttcaaaattccaagagaagaccaattgggagcagtttcttgcaatttttctatacgagtttaactctcttttcagcgacaaaataaatacaaaagatggagaaacaaagcaagttggatactatctatttgccaaagacctgcataatcttatcttaagtgagcagattgatattccaaaagattcaaaagtcacaataaaagattttgccgattctgtactcacaatctaccaaatggcaaaatattttgcggtagaaaaaaaacgagcgtggcttgccgagtatgaactagattcattttatacccagccagacacaggctatttacagttttatgataacgcctacgaggatattgtgcaggtatacaacaagcttcgaaactatctgaccaaaaagccatatagcgaggagaaatggaagttgaattttgaaaattctacgctggcaaatggatgggataagaacaaagaatctgataattcagcagttattctacaaaaaggtggaaaatattatttgggactgattactaaaggacacaacaaaatttttgatgaccgttttcaagaaaaatttattgtgggaattgaaggtggaaaatatgaaaaaatagtctataaatttttccccgaccaggcaaaaatgtttcccaaagtgtgcttttctgcaaaaggactcgaattttttagaccgtctgaagaaattttaagaatttataacaatgcagagtttaaaaaaggagaaacttattcaatagatagtatgcagaagttgattgatttttataaagattgcttgactaaatatgaaggctgggcatgttatacctttcggcatctaaaacccacagaagaataccaaaacaatattggagagttttttcgagatgttgcagaggacggatacaggattgattttcaaggcatttcagatcaatatattcatgaaaaaaacgagaaaggcgaacttcacctttttgaaatccacaataaagattggaatttggataaggcacgagacggaaagtcaaaaacaacacaaaaaaaccttcatacactctatttcgaatcgctcttttcaaacgataatgttgttcaaaactttccaataaaactcaatggtcaagctgaaattttttatagaccgaaaacggaaaaagacaaattagaatcaaaaaaagataagaaagggaataaagtgattgaccataaacgctatagtgagaataagattttttttcatgttcctctcacactaaaccgcactaaaaatgactcatatcgctttaatgctcaaatcaacaactttctcgcaaataataaagatatcaacatcatcggtgtagataggggagaaaagcatttagtctattattcggtgattacacaagctagtgacatcttagaaagtggctcactaaatgagctaaatggcgtgaattatgctgaaaaactgggaaaaaaggcagaaaatcgagaacaagcacgcagagactggcaagacgtacaagggatcaaagacctcaagaaaggatatatttcacaggtggtgcgaaagcttgctgatttagcaattaaacacaatgccattatcattcttgaagatttgaatatgagatttaaacaagttcggggcggtatcgaaaaatccatttatcaacagttagaaaaagcactgatagataaattaagctttcttgtagacaaaggtgaaaaaaatcccgagcaagcaggacatcttctgaaagcatatcagctttcggccccatttgagacatttcaaaaaatgggcaaacagacgggtataatcttttatacacaagcttcgtatacctcaaaaagtgaccctgtaacaggttggcgaccacacctgtatctcaaatatttcagtgccaaaaaagcaaaagacgatattgcaaagtttacaaaaatagaatttgtaaacgataggtttgagcttacctatgatataaaggactttcagcaagcaaaagaatatccaaataaaactgtttggaaagtttgctcaaatgtagagagattcaggtgggacaaaaacctcaatcaaaacaaaggcggatatactcactacacaaatataactgagaatatccaagagctttttacaaaatatggaattgatatcacaaaagatttgctcacacagatttctacaattgatgaaaaacaaaatacctcattttttagagattttattttttatttcaaccttatttgccaaatcagaaataccgatgattctgagattgctaaaaagaatgggaaagatgattttatactgtcacctgttgagccgtttttcgatagccgaaaagacaatggaaataaacttcctgagaatggagatgataacggcgcgtataacatagcaagaaaagggattgtcatactcaacaaaatctcacaatattcagagaaaaacgaaaattgcgagaaaatgaaatggggggatttgtatgtatcaaacattgactgggacaattttgtaacccaagctaatgcacggcattaa

SEQ ID NO: 31 - DNA, 3516 bp, Artificial Sequence
  Description of Artificial Sequence: Synthetic polynucleotide
atgattatcttatatattagtacctcgaatatgaacatggaaggagtatttatggaaaattttaaaaacttgtatccaataaacaaaacacttcgatttgaattaagaccctatggaaaaacattggaaaattttaaaaaatccggacttttagaaaaagatgcctttaaggcaaatagtagacgaagtatgcaagctataatcgatgaaaaattcaaagagactatcgaagaacgcttaaagtacactgaattcagtgaatgtgatcttggaaacatgacatcaaaagataaaaaaataactgataaagcagctacaaatttaaaaaagcaagttatcttatcttttgacgatgaaatatttaataattacctaaaacctgataaaaatattgacgcattatttaaaaatgatccttcaaatcctgtaatctctacatttaaaggttttacgacatattttgtgaatttttttgaaattcgaaaacatattttcaagggagaatcatcaggctcaatggcataccgaattatagatgaaaacctgacaacatacttgaataatattgaaaaaataaaaaaactgccagaagaattaaaatcacagctagaaggcattgatcagattgataaacttaataattataatgagttcattacacagtcaggtataacacactataatgaaatcatcggcggtatatcaaaatcagagaatgtcaaaatacagggaattaatgaaggaattaatctatactgtcagaagaacaaagttaaacttcctcgactgactccgctatacaaaatgatattatcagacagagtttccaactcttttgtattagacactattgaaaatgacacagaattaattgaaatgataagtgatttgattaataagactgagatttcgcaagatgttataatgtcagatattcaaaatattttcataaaatacaaacaacttggtaatttgccgggtatctcatattcttcaatagttaatgctatttgctcggattatgacaacaatttcggagatgggaagcgaaaaaaatcttacgaaaatgatcgcaaaaagcatttggagactaatgtatactccataaattatatttctgaattgcttacagataccgatgtttcatcaaatatcaagatgagatataaagagcttgagcaaaattatcaggtttgcaaagaaaattttaatgccacaaactggatgaatattaaaaatataaaacaatctgaaaaaacaaaccttattaaagatttgttagatatacttaaatcgattcaacgtttctatgatttgtttgatattgttgacgaagataaaaatccaagtgctgaattttatacctggttatcaaaaaatgctgaaaagcttgactttgaattcaattctgtatataacaagtcacgaaactatctcaccaggaaacaatactctgataaaaaaatcaagctgaattttgattctccaacattggccaaagggtgggatgctaacaaagaaatagataactccacgattataatgcgtaaatttaataatgacagaggcgattatgattacttccttggcatatggaataaatccacacctgcaaatgaaaaaataatcccactggaggataatggattattcgaaaaaatgcaatataagctgtatccagatcctagtaagatgttaccgaaacaatttctatcaaaaatatggaaggcaaagcatcctacgacacctgaatttgataaaaaatataaagagggaagacataaaaaaggtcctgatttcgaaaaagaattcctgcatgaattgattgattgcttcaaacatggtcttgttaatcacgatgaaaaatatcaggatgtttttggcttcaatctccgtaacactgaagattataattcatatacagagtttctcgaagatgtggaaagatgcaattacaatctttcatttaacaaaattgctgatacttcaaaccttattaatgatgggaaattgtatgtatttcagatatggtcaaaagacttttctattgattcaaaaggtactaaaaacttgaatacaatctattttgaatcactattttcagaagaaaacatgatagaaaaaatgttcaagctttctggagaggctgagatattctatcgaccagcatcgttgaattattgtgaagatatcataaaaaaaggtcatcaccatgcagaattaaaagataagtttgactatcctataataaaagataagcgatattcacaagataagtttttctttcatgtgccaatggttataaattataaatctgagaaactgaattccaaaagccttaacaaccgaacaaatgaaaacctgggacagtttacacatattataggtatagacaggggcgagcggcacttgatttatttaactgttgttgatgtttccactggtgaaatcgttgaacagaaacatctggacgaaattatcaatactgataccaagggagttgaacacaaaacccattatttgaataaattggaagaaaaatctaaaacaagagataacgagcgtaaatcatgggaagctattgaaactatcaaagaattaaaagaaggctatatttctcatgtaattaatgaaatacaaaagctgcaagaaaaatataatgccttaatcgtaatggaaaatcttaactatgggttcaaaaactcacgaatcaaagttgaaaaacaggtttatcaaaaattcgagacagcattgattaaaaagttcaattatattattgataaaaaagatccagaaacctatatacatggttaccagcttacaaatcctattaccactctggataagattggaaatcaatctggaatagtgctgtatattcctgcgtggaatacttctaagatagatcccgtcacaggatttgtaaaccttctgtacgcagatgatttgaagtataaaaatcaggagcaggccaaatcattcattcagaaaatagacaacatatattttgaaaatggagagtttaaatttgatattgatttttccaaatggaataatcgctactcaataagtaaaactaaatggacgttaacaagttatgggactcgcatccagacatttagaaatccccagaaaaacaataagtgggattctgctgaatatgatttgacagaagagtttaaattaattttaaatatagacggaacgttaaagtcacaggacgtagaaacatacaaaaaattcatgtctttatttaaactaatgctacagcttcgaaactctgttacaggaaccgacattgattatatgatctctcctgtcactgataaaacaggaacacatttcgattcaagagaaaatattaaaaatcttcctgccgatgcagatgccaatggtgcctacaacattgcgcgcaaaggaataatggctattgaaaatataatgaacggtataagcgatccactaaaaataagcaacgaagactatttaaagtatattcagaatcaacaggaataa

SEQ ID NO: 32 - DNA, 3924 bp, Artificial Sequence
  Description of Artificial Sequence: Synthetic polynucleotide
atgacccaatttgaaggttttaccaatttataccaagtttcgaagacccttcgttttgaactgattccccaaggaaaaacactcaaacatatccaggagcaagggttcattgaggaggataaagctcgcaatgaccattacaaagagttaaaaccaatcattgaccgcatctataagacttatgctgatcaatgtctccaactggtacagcttgactgggagaatctatctgcagccatagactcctatcgtaaggaaaaaaccgaagaaacacgaaatgcgctgattgaggagcaagcaacatatagaaatgcgattcatgactactttataggtcggacggataatctgacagatgccataaataagcgccatgctgaaatctataaaggactttttaaagctgaacttttcaatggaaaagttttaaagcaattagggaccgtaaccacgacagaacatgaaaatgctctactccgttcgtttgacaaatttacgacctatttttccggcttttatgaaaaccgaaaaaatgtctttagcgctgaagatatcagcacggcaattccccatcgaatcgtccaggacaatttccctaaatttaaggaaaactgccatatttttacaagattgataaccgcagttccttctttgcgggagcattttgaaaatgtcaaaaaggccattggaatctttgttagtacgtctattgaagaagtcttttcctttcccttttataatcaacttctaacccaaacgcaaattgatctttataatcaacttctcggcggcatatctagggaagcaggcacagaaaaaatcaagggacttaatgaagttctcaatctggctatccaaaaaaatgatgaaacagcccatataatcgcgtccctgccgcatcgttttattcctctttttaaacaaattctttccgatcgaaatacgttatcctttattttggaagaattcaaaagcgatgaggaagtcatccaatccttctgcaaatataaaaccctcttgagaaacgaaaatgtactggagactgcagaagcccttttcaatgaattaaattccattgatttgactcatatctttatttcccataaaaagttagaaaccatctcttcagcgctttgtgaccattgggataccttgcgcaatgcactttacgaaagacggatttctgaactcactggcaaaataacaaaaagtgccaaagaaaaagttcaaaggtcattaaaacatgaggatataaatctccaagaaattatttctgctgcaggaaaagaactatcagaagcattcaaacaaaaaacaagtgaaattctttcccatgcccatgctgcacttgaccagcctcttcccacaacattaaaaaaacaggaagaaaaagaaatcctcaaatcacagctcgattcgcttttaggcctttatcatcttcttgattggtttgctgtcgatgaaagcaatgaagtcgacccagaattctcagcacggctgacaggcattaaactagaaatggaaccaagcctttcgttttataataaagcaagaaattatgcgacaaaaaagccctattcggtggaaaaatttaaattgaattttcaaatgccaacccttgcctctggttgggatgtcaataaagaaaaaaataatggagctattttattcgtaaaaaatggtctctattaccttggtatcatgcctaaacagaaggggcgctataaagccctgtcttttgagccgacagaaaaaacatcagaaggattcgataagatgtactatgactacttcccagatgccgcaaaaatgattcctaagtgttccactcagctaaaggctgtaaccgctcattttcaaactcataccacccccattcttctctcaaataatttcattgaacctcttgaaatcacaaaagaaatttatgacctgaacaatcctgaaaaggagcctaaaaagtttcaaacggcttatgcaaagaagacaggcgatcaaaaaggctatagagaagcgctttgcaaatggattgactttacgcgggattttctctctaaatatacgaaaacaacttcaatcgatttatcttcactccgcccttcttcgcaatataaagatttaggggaatattacgccgaactgaatccgcttctctatcatatctccttccaacgaattgctgaaaaggaaatcatggatgctgtagaaacgggaaaattgtatctgttccaaatctacaataaggattttgcgaagggccatcacgggaaaccaaatctccacaccctgtattggacaggtctcttcagtcctgaaaaccttgcgaaaaccagcatcaaacttaatggtcaagcagaattgttctatcgacctaaaagccgcatgaagcggatggcccatcgtcttggggaaaaaatgctgaacaaaaaactaaaggaccagaagacaccgattccagataccctctaccaagaactgtacgattatgtcaaccaccggctaagccatgatctttccgatgaagcaagggccctgcttccaaatgttatcaccaaagaagtctcccatgaaattataaaggatcggcggtttacttccgataaatttttcttccatgttcccattacactgaattatcaagcagccaatagtcccagtaaattcaaccagcgtgtcaatgcctaccttaaggagcatccggaaacgcccatcattggtatcgatcgtggagaacgcaatctaatctatattaccgtcattgacagtactgggaaaattttggagcagcgttccctgaataccatccagcaatttgactaccaaaaaaaattggacaacagggaaaaagagcgtgttgccgcccgtcaagcctggtccgtcgtcggaacgatcaaagaccttaaacaaggctacttgtcacaggtcatccatgaaattgtagacctgatgattcattaccaagctgttgtcgtccttgaaaacctcaacttcggatttaaatcaaaacggacaggcattgccgaaaaagcagtctaccaacaatttgaaaagatgctaatagataaactcaactgtttggttctcaaagattatcctgctgagaaagtgggaggcgtcttaaacccgtatcaacttacagatcagttcacgagctttgcaaaaatgggcacgcaaagcggcttccttttctatgtaccggccccttatacctcaaagattgatcccctgactggttttgtcgatccctttgtatggaagaccattaaaaatcatgaaagtcggaagcatttcctagaaggatttgatttcctgcattatgatgtcaaaacaggtgattttatcctccattttaaaatgaatcggaatctctctttccagagagggcttcctggcttcatgccagcttgggatattgttttcgaaaagaatgaaacccaatttgatgcaaaagggacgcccttcattgcaggaaaacgaattgttcctgtaatcgaaaatcatcgttttacgggtcgttacagagacctctatcccgctaatgaactcattgcccttctggaagaaaaaggcattgtctttagagacggaagtaatatattacccaaacttttagaaaatgatgattctcatgcaattgatacgatggtcgccttgattcgcagtgtactccaaatgagaaacagcaatgccgcaacgggggaagactacatcaactctcccgttagggatctgaacggggtgtgtttcgacagtcgattccaaaatccagaatggccaatggatgcggatgccaacggagcttatcatattgccttaaaagggcagcttcttctgaaccacctcaaagaaagcaaagatctgaaattacaaaacggcatcagcaaccaagattggctggcctacattcaggaactgagaaactga

SEQ ID NO: 33 - DNA, 3390 bp, Artificial Sequence
  Description of Artificial Sequence: Synthetic polynucleotide
atggccgtcaaatccatcaaagtgaaacttcgtctcgacgatatgccggagattcgggccggtctatggaaacttcataaggaagtcaatgcgggggttcgatattacacggaatggctcagtcttctccgtcaagagaacttgtatcgaagaagtccgaatggggacggagagcaagaatgtgataagactgcagaagaatgcaaagccgaattgttggagcggctgcgcgcgcgtcaagtggagaatggacaccgtggtccggcgggatcggacgatgaattgctgcagttggcgcgtcaactctatgagttgttggttccgcaggcgataggtgcgaaaggcgacgcgcagcaaattgcccgcaaatttttgagccccttggccgacaaggacgcagttggtgggcttggaatcgcgaaggcggggaacaaaccgcggtgggttcgcatgcgcgaagcgggggaaccaggctgggaagaggagaaggagaaggctgagacgaggaaatctgcggatcggactgcggatgttttgcgcgcgctcgcggattttgggttaaagccactgatgcgcgtatacaccgattctgagatgtcatcggtggagtggaaaccgcttcggaagggacaagccgttcggacgtgggatagggacatgttccaacaagctatcgaacggatgatgtcgtgggagtcgtggaatcagcgcgttgggcaagagtacgcgaaactcgtagaacaaaaaaatcgatttgagcagaagaatttcgtcggccaggaacatctggtccatctcgtcaatcagttgcaacaagatatgaaagaagcatcgcccggactcgaatcgaaagagcaaaccgcgcactatgtgacgggacgggcattgcgcggatcggacaaggtatttgagaagtgggggaaactcgcccccgatgcacctttcgatttgtacgacgccgaaatcaagaatgtgcagagacgtaacacgagacgattcggatcacatgacttgttcgcaaaattggcagagccagagtatcaggccctgtggcgcgaagatgcttcgtttctcacgcgttacgcggtgtacaacagcatccttcgcaaactgaatcacgccaaaatgttcgcgacgtttactttgccggatgcaacggcgcacccgatttggactcgcttcgataaattgggtgggaatttgcaccagtacacctttttgttcaacgaatttggagaacgcaggcacgcgattcgttttcacaagctattgaaagtcgagaatggtgtcgcaagagaagttgatgatgtcaccgtgcccatttcaatgtcagagcaattggataatctgcttcccagagatcccaatgaaccgattgcgctatattttcgagattacggagccgaacagcatttcacaggtgaatttggtggcgcgaagatccagtgccgccgggatcagctggctcatatgcaccgacgcagaggggcgagggatgtttatctcaatgtcagcgtacgtgtgcagagtcagtctgaggcgcggggagaacgtcgcccgccgtatgcggcagtatttcgtctggtcggggacaaccatcgcgcgtttgtccatttcgataaactatcggattatcttgcggaacatccggatgatgggaagctcgggtcggaggggttgctttccgggctgcgggtgatgagtgtcgatctcggccttcgcacatctgcatcgatttccgtttttcgcgttgcccggaaggacgagttgaagccgaactcaaaaggtcgtgtaccgtttttctttccgataaaagggaatgacaatctcgtcgcggttcatgagcgatcacaactcttgaagctgcctggcgaaacggagtcgaaggacctgcgtgctatccgagaagaacgccaacggacattgcggcagttgcggacgcaactggcgtatttgcggctgctcgtgcggtgtgggtcggaagatgtggggcggcgtgaacggagttgggcaaagcttatcgagcagccggtggatgcggccaatcacatgacaccggattggcgcgaggcttttgaaaacgaacttcagaagcttaagtcactccatggtatctgtagcgacaaggaatggatggatgctgtctacgagagcgttcgccgcgtgtggcgtcacatgggcaaacaggttcgcgattggcgaaaggacgtacgaagcggagagcggcccaagattcgcggctatgcgaaagacgtggtcggtggaaactcgattgagcaaatcgagtatctggaacgtcagtacaagttcctcaagagttggagcttctttggtaaggtgtcgggacaagtgattcgtgcggagaagggatctcgttttgcgatcacgctgcgcgaacacattgatcacgcgaaggaagatcggctgaagaaattggcggatcgcatcattatggaggctctcggctatgtgtacgcgttggatgagcgcggcaaaggaaagtgggttgcgaagtatccgccgtgccagctcatcctgctggaggaattgagcgagtaccagttcaataacgacaggcctccgagcgaaaacaaccagttgatgcaatggagtcatcgcggcgtgttccaggagttgataaatcaggcccaagtccatgatttactcgttgggacgatgtatgcagcgttctcgtcgcgattcgacgcgcgaactggggcaccgggtatccgctgtcgccgggttccggcgcgttgcacccaggagcacaatccagaaccatttccttggtggctgaacaagtttgtggtggaacatacgttggatgcttgtcccctacgcgcagacgacctcatcccaacgggtgaaggagagatttttgtctcgccgttcagcgcggaggagggggactttcatcagattcacgccgacctgaatgcggcgcaaaatctgcagcagcgactctggtctgattttgatatcagtcaaattcggttgcggtgtgattggggtgaagtggacggtgaactcgttctgatcccaaggcttacaggaaaacgaacggcggattcatatagcaacaaggtgttttataccaatacaggtgtcacctattatgagcgagagcgggggaagaagcggagaaaggttttcgcgcaagagaaattgtcggaggaagaggcggagttgctcgtggaagcagacgaggcgagggagaaatcggtcgttttgatgcgtgatccgtctggcatcatcaatcggggaaattggaccaggcaaaaggaattttggtcgatggtgaaccagcggatcgaaggatacttggtcaagcagattcgctcgcgcgttccattacaagatagtgcgtgtgaaaacacgggggatatttaa

SEQ ID NO: 34 - DNA, 3327 bp, Artificial Sequence
  Description of Artificial Sequence: Synthetic polynucleotide
atggcgacacgcagttttattttaaaaattgaaccaaatgaagaagttaaaaagggattatggaagacgcatgaggtattgaatcatggaattgcctactacatgaatattctgaaactaattagacaggaagctatttatgaacatcatgaacaagatcctaaaaatccgaaaaaagtttcaaaagcagaaatacaagccgagttatgggattttgttttaaaaatgcaaaaatgtaatagttttacacatgaagttgacaaagatgttgtttttaacatcctgcgtgaactatatgaagagttggtccctagttcagtcgagaaaaagggtgaagccaatcaattatcgaataagtttctgtacccgctagttgatccgaacagtcaaagtgggaaagggacggcatcatccggacgtaaacctcggtggtataatttaaaaatagcaggcgacccatcgtgggaggaagaaaagaaaaaatgggaagaggataaaaagaaagatccccttgctaaaatcttaggtaagttagcagaatatgggcttattccgctatttattccatttactgacagcaacgaaccaattgtaaaagaaattaaatggatggaaaaaagtcgtaatcaaagtgtccggcgacttgataaggatatgtttatccaagcattagagcgttttctttcatgggaaagctggaaccttaaagtaaaggaagagtatgaaaaagttgaaaaggaacacaaaacactagaggaaaggataaaagaggacattcaagcatttaaatcccttgaacaatatgaaaaagaacggcaggagcaacttcttagagatacattgaatacaaatgaataccgattaagcaaaagaggattacgtggttggcgtgaaattatccaaaaatggctaaagatggatgaaaatgaaccatcagaaaaatatttagaagtatttaaagattatcaacggaaacatccacgagaagccggggactattctgtctatgaatttttaagcaagaaagaaaatcattttatttggcgaaatcatcctgaatatccttatttgtatgctacattttgtgaaattgacaaaaaaaagaaagacgctaagcaacaggcaacttttactttggctgacccgattaaccatccgttatgggtacgatttgaagaaagaagcggttcgaacttaaacaaatatcgaattttaacagagcaattacacactgaaaagttaaaaaagaaattaacagttcaacttgatcgtttaatttatccaactgaatccggcggttgggaggaaaaaggtaaagtagatatcgttttgttgccgtcaagacaattttataatcaaatcttccttgatatagaagaaaaggggaaacatgcttttacttataaggatgaaagtattaaattcccccttaaaggtacacttggtggtgcaagagtgcagtttgaccgtgaccatttgcggagatatccgcataaagtagaatcaggaaatgttggacggatttattttaacatgacagtaaatattgaaccaactgagagccctgttagtaagtctttgaaaatacatagggacgatttccccaagttcgttaattttaaaccgaaagagctcaccgaatggataaaagatagtaaagggaaaaaattaaaaagtggtatagaatcccttgaaattggtctacgggtgatgagtatcgacttaggtcaacgtcaagcggctgctgcatcgatttttgaagtagttgatcagaaaccggatattgaagggaagttattttttccaatcaaaggaactgagctttatgctgttcaccgggcaagttttaacattaaattaccgggtgaaacattagtaaaatcacgggaagtattgcggaaagctcgggaggacaacttaaaattaatgaatcaaaagttaaactttctaagaaatgttctacatttccaacagtttgaagatatcacagaaagagagaagcgtgtaactaaatggatttctagacaagaaaatagtgatgttcctcttgtatatcaagatgagctaattcaaattcgtgaattaatgtataaaccctataaagattgggttgcctttttaaaacaactccataaacggctagaagtcgagattggcaaagaggttaagcattggcgaaaatcattaagtgacgggagaaaaggtctttacggaatctccctaaaaaatattgatgaaattgatcgaacaaggaaattccttttaagatggagcttacgtccaacagaacctggggaagtaagacgcttggaaccaggacagcgttttgcgattgatcaattaaaccacctaaatgcattaaaagaagatcgattaaaaaagatggcaaatacgattatcatgcatgccttaggttactgttatgatgtaagaaagaaaaagtggcaggcaaaaaatccagcatgtcaaattattttatttgaagatttatctaactacaatccttacgaggaaaggtcccgttttgaaaactcaaaactgatgaagtggtcacggagagaaattccacgacaagtcgccttacaaggtgaaatttacggattacaagttggggaagtaggtgcccaattcagttcaagattccatgcgaaaaccgggtcgccgggaattcgttgcagtgttgtaacgaaagaaaaattgcaggataatcgcttttttaaaaatttacaaagagaaggacgacttactcttgataaaatcgcagttttaaaagaaggagacttatatccagataaaggtggagaaaagtttatttctttatcaaaggatcgaaagttggtaactacgcatgctgatattaacgcggcccaaaatttacagaagcgtttttggacaagaacacatggattttataaagtttactgcaaagcctatcaggttgatggacaaactgtttatattccggagagcaaggaccaaaaacaaaaaataattgaagaatttggggaaggctattttattttaaaagatggtgtatatgaatggggtaatgcggggaaactaaaaattaaaaaaggttcctctaaacaatcatcgagtgaattagtagattcggacatactgaaagattcatttgatttagcaagtgaacttaagggagagaaactcatgttatatcgagatccgagtggaaacgtatttccttccgacaagtggatggcagcaggagtattttttggcaaattagaaagaatattgatttctaagttaacaaatcaatactcaatatcaacaatagaagatgattcttcaaaacaatcaatgtaa

SEQ ID NO: 35 - DNA, 3450 bp, Artificial Sequence
  Description of Artificial Sequence: Synthetic polynucleotide
atgcccacccgcaccatcaatctgaaacttgttcttgggaaaaatcctgaaaacgcaacattgcgacgcgccctattttcgacacaccgtttggttaaccaagcgacgaaacgtattgaggaattcttgttgctgtgtcgtggagaagcctacagaacagtggataatgaggggaaggaagccgagattccacgtcatgcagtccaagaagaagctcttgcctttgccaaagctgctcaacgccacaacggctgtatatccacctatgaagaccaagagattcttgatgtactgcggcaactgtacgaacgtcttgttccttcggtcaacgaaaacaacgaggcaggcgatgctcaagctgctaacgcctgggtcagtccgctcatgtcggcagaaagcgaaggaggcttgtcggtctacgacaaggtgcttgatccaccgccggtttggatgaagcttaaagaagaaaaggctccaggatgggaagccgcttctcaaatttggattcagagtgatgagggacagtcgttacttaataagccaggtagccctccccgctggattcgaaaactgcgatctgggcaaccgtggcaagatgatttcgtcagtgaccaaaagaaaaagcaagatgagctgaccaaagggaacgcaccacttataaaacaactcaaagaaatggggttgttgcctcttgttaacccattttttagacatcttcttgaccctgaaggtaaaggcgtgagtccatgggaccgtcttgctgtacgcgctgcagtggctcactttatctcctgggaaagttggaatcatagaacacgtgcagaatacaattccttgaaactacggcgagacgagtttgaggcagcatccgacgaattcaaagacgattttactttgctccgacaatatgaagccaaacgccatagtacattgaaaagcatcgcgctggccgacgattcgaacccttaccggattggagtacgttctctgcgtgcctggaaccgcgttcgtgaagaatggatagacaagggtgcaacagaagaacaacgcgtgaccatattgtcaaagcttcaaacacaacttcggggaaaattcggcgatcccgatctgttcaactggctagctcaggataggcatgtccatttgtggtctcctcgggacagcgtgacaccattggttcgcatcaatgcggtagataaagttctgcgtcgacgaaaaccgtatgcattgatgacctttgcccatccccgcttccaccctcgatggatactgtacgaggctccaggaggaagcaatctccgtcaatatgcattggattgtacagaaaacgctctacacatcacgttgcctttgcttgtcgacgatgcgcacggaacctggattgaaaaaaagatcagggtgccgctggcaccatccggacaaattcaagatttaactctggaaaaacttgagaagaaaaaaaatcgtttatactaccgttccggttttcagcagtttgccggcttggctggcggagctgaggttcttttccacagaccctatatggaacacgacgaacgcagcgaggagtctcttttggaacgtccgggagccgtttggttcaaattgaccctggatgtggcaacacaggctcccccgaactggcttgatggtaagggccgtgtccgtacaccgccggaggtacatcattttaaaaccgcattgtcgaataaaagcaaacatacacgtacgctgcagccgggtctccgtgtcttgtcagtagacttgggcatgcgaacattcgcctcctgctcagtatttgaactcatcgagggaaagcctgagacaggccgtgccttccctgttgccgatgagagatcaatggacagcccgaataaactgtgggccaagcatgaacgtagttttaaactgacgctccccggcgaaaccccttctcgaaaggaagaggaagagcgtagcatagcaagagcggaaatttatgcactgaaacgcgacatacaacgcctcaaaagcctactccgcttaggtgaagaagataacgataaccgtcgtgatgcattgcttgaacagttctttaaaggatggggagaagaagacgttgtgcctggacaagcgtttccacgctctcttttccaagggttgggagctgccccgtttcgctcaactccagagttatggcgtcagcattgccaaacatattatgacaaagcggaagcctgtctggctaaacatatcagtgattggcgcaagcgaactcgtccccgtccgacatcgcgggagatgtggtacaaaacacgttcctatcatggcggcaagtccatttggatgttggaatatcttgatgccgttcgaaaactgcttctcagttggagcttacgtggtcgtacttacggtgccattaatcgccaggatacagcccggtttggttctttggcatcacggctgctccaccatatcaattccctaaaggaagaccgcatcaaaacaggagccgactctatcgttcaggctgctcgcgggtatattcctctccctcatggcaagggttgggaacaaagatatgagccttgtcagctcatattatttgaagacctcgcacgatatcgctttcgcgtggatcgacctcgtcgagagaacagccaactcatgcagtggaaccatcgagccatcgtggcagaaacaacgatgcaagccgaactctacggacaaattgtcgaaaatactgcagcggggttcagcagtcgttttcacgcggcgacaggtgcccccggtgtacgttgtcgttttcttctagaaagagactttgataacgatttgcccaaaccgtaccttctcagggaactttcttggatgctcggcaatacaaaagtcgagtctgaagaagaaaagcttcgattgctgtctgaaaaaatcaggccaggcagtcttgttccttgggatggaggcgaacagttcgctaccctgcatcccaaaagacaaacactttgcgtcattcatgccgatatgaatgctgcccaaaatttacaacgccggtttttcggtcgatgcggcgaggcctttcggcttgtttgtcaaccccacggtgacgacgtgttacgactcgcatccaccccaggagctcgtcttcttggagccctgcagcagcttgaaaatggacaaggagctttcgagttggttcgagacatggggtcaacaagtcaaatgaaccggttcgtcatgaagtctttgggaaaaaagaaaataaaaccccttcaggacaacaatggagacgacgagcttgaagacgtgttgtccgtactcccggaggaagacgacacaggacgtatcacagtcttccgcgattcatcaggaatcttttttccttgcaacgtctggataccggccaaacagttttggccagcagtacgcgccatgatttggaaggtcatggcttcccattctttggggtga

SEQ ID NO: 36 - DNA, 3759 bp, Artificial Sequence
  Description of Artificial Sequence: Synthetic polynucleotide
atgacaaagttaagacaccgacagaaaaaattaacacacgactgggctggctccaaaaagagggaagtattaggctcaaatggcaagcttcagaatccgttgttaatgccggttaaaaaaggtcaggttactgagttccggaaagcgttttctgcgtatgctcgcgcaacgaaaggagaaatgactgacggccgaaagaatatgtttacgcatagtttcgagccatttaagacaaagccctcgcttcatcagtgtgaattggcagataaagcatatcaatctttacattcgtatctgcctggttctcttgctcattttctattatctgctcacgcattaggttttcgtattttttcaaaatctggtgaagcaactgcattccaggcatcctctaaaattgaagcttacgaatcaaaattggcaagcgaattagcttgtgtagatttatctattcaaaacttgactatttcaacgctttttaatgcgcttacaacgtctgtaagagggaagggcgaagaaactagcgctgaccccttaattgcacgattttacaccttacttactggcaagcctctgtctcgagacactcaagggcctgaacgtgatttagcagaagttatctcgcgtaagatagctagttcttttggcacatggaaagaaatgacggcaaaccctcttcagtcattacaattttttgaagaggaactccatgcgctggatgccaatgtctcgctctcacccgccttcgacgttttaattaaaatgaatgatttgcagggcgatttaaaaaatcgaaccattgtttttgatcctgacgcccctgtttttgaatataacgcagaagaccctgccgacataattattaaacttacagctcgttacgctaaagaagctgtcatcaaaaatcaaaacgtaggaaattacgttaaaaacgctattactaccacaaatgccaatggtcttggttggcttttgaacaaaggtttgtcgttactccctgtctcgaccgatgacgaattgctagagtttattggcgttgaacgatctcatccctcatgccatgccttaattgaattgattgcacaattagaagcccccgagctctttgagaagaacgtattttcagatactcgttctgaagttcaaggtatgattgattcagctgtttctaatcatattgctcgtctttccagctctagaaatagcttgtcaatggatagtgaagaattagaacgtttaatcaaaagctttcagatacacacacctcattgctcactttttattggcgcccaatcactttcacagcagttagaatctttgcctgaagcccttcaatcgggcgttaattcagccgatattttactaggctctactcaatatatgctcaccaattctttggttgaagagtcaattgcaacttatcaaagaacacttaatcgcatcaattacttgtcaggtgttgcaggtcagattaacggcgcaataaagcgaaaagcgatagatggagaaaaaattcacttgcctgcagcttggtcagagttgatatctttaccatttataggccagcctgttatagatgttgaaagcgatttagctcatctaaaaaatcaataccaaacactttcaaatgagtttgatactcttatatctgctttgcaaaagaattttgatttgaactttaataaagcgctccttaatcgtactcagcattttgaagccatgtgtagaagcactaagaaaaacgctttatccaaaccagagatcgtttcctatcgcgacctgcttgctcgattaacttcttgtttgtatcgaggctctttagttttgcgtcgtgccggcattgaagtgttaaaaaaacataaaatatttgagtcaaacagcgaacttcgtgaacatgttcatgaaagaaagcatttcgtgtttgttagtcctctagatcgcaaagccaagaaactccttcgattaactgattcgcgtccagacttgttacatgttattgatgaaatattgcagcacgataatcttgaaaacaaagaccgcgagtcactttggctagttcgctctggttatttgcttgcaggacttccagatcaactttcttcatcttttattaacttgcctatcattactcaaaaaggagatagacgccttatagacctgattcagtatgatcaaattaatcgtgatgcttttgttatgttagtgacctctgcattcaagtctaatttgtctggtctgcagtatcgtgccaataagcaatcgttcgttgttactcgcacgctaagcccttatctcggctcaaaacttgtctacgtacccaaggataaagattggttagttccttctcaaatgtttgaaggacgatttgctgacattcttcaatcagattatatggtctggaaagatgccggtcgtctttgtgttattgatactgcaaaacacctttctaatataaagaagtctgtattttcatccgaagaagttctcgcttttttaagagaactccctcaccgcacatttatccagaccgaagttcgcggccttggcgttaatgtcgatggaattgcatttaataatggtgatattccgtcattaaaaaccttttcaaattgcgttcaggtaaaagtttctcggactaatacatccctagttcaaacacttaatcgttggtttgaaggaggaaaagtttctcctccgagcattcaatttgaacgggcgtattataaaaaagacgatcaaattcatgaagacgcagcgaaaagaaagatacgattccagatgcccgcaactgagttggttcatgcttctgacgatgcggggtggacaccaagttatttgctcggcattgatcctggcgagtatggaatgggtctttcattggtttcgattaataacggagaagtcttagattcaggctttattcatattaattctctgatcaattttgcctctaaaaagagcaaccatcaaactaaggttgttccgcgtcagcagtacaaatctccttatgcaaattatttagaacaatctaaagattctgctgctggtgatattgcgcatatactcgatcgacttatatacaaattaaatgcgttgcctgtttttgaggctctttcaggtaattctcagagtgctgctgatcaagtttggacgaaagtcttatcgttttacacttggggtgataatgacgctcagaattctattagaaagcagcattggtttggagccagtcattgggatatcaaaggtatgttaaggcaaccccctacggagaagaagcctaaaccgtatattgcttttcctggctctcaggtttcttcgtatggtaattcccaacgttgctcttgctgcggtcgcaatcctattgaacaacttcgagaaatggcaaaggatacctctattaaagagctaaaaattcgcaattctgagatacagctttttgacggaaccattaaattatttaatccagacccatccactgtgatagagagaaggcgacataatcttggtccatcaagaattcctgttgctgaccgtactttcaaaaacatcagtccatcaagtctagaatttaaagaattgattactatcgtgtctcgatctatccgtcattcacctgagtttatcgctaaaaaacgcggcatagggtctgagtatttttgcgcttattccgattgcaactcatccttaaattctgaagctaacgcagctgctaacgtagcgcaaaaatttcaaaaacagttattttttgagttataa

SEQ ID NO: 37 - DNA, 3864 bp, Artificial Sequence
  Description of Artificial Sequence: Synthetic polynucleotide
atgaagagaattctgaacagtctgaaagttgctgccttgagacttctgtttcgaggcaaaggttctgaattagtgaagacagtcaaatatccattggtttccccggttcaaggcgcggttgaagaacttgctgaagcaattcggcacgacaacctgcacctttttgggcagaaggaaatagtggatcttatggagaaagacgaaggaacccaggtgtattcggttgtggatttttggttggataccctgcgtttagggatgtttttctcaccatcagcgaatgcgttgaaaatcacgctgggaaaattcaattctgatcaggtttcaccttttcgtaaggttttggagcagtcacctttttttcttgcgggtcgcttgaaggttgaacctgcggaaaggatactttctgttgaaatcagaaagattggtaaaagagaaaacagagttgagaactatgccgccgatgtggagacatgcttcattggtcagctttcttcagatgagaaacagagtatccagaagctggcaaatgatatctgggatagcaaggatcatgaggaacagagaatgttgaaggcggatttttttgctatacctcttataaaagaccccaaagctgtcacagaagaagatcctgaaaatgaaacggcgggaaaacagaaaccgcttgaattatgtgtttgtcttgttcctgagttgtatacccgaggtttcggctccattgctgattttctggttcagcgacttaccttgctgcgtgacaaaatgagtaccgacacggcggaagattgcctcgagtatgttggcattgaggaagaaaaaggcaatggaatgaattccttgctcggcacttttttgaagaacctgcagggtgatggttttgaacagatttttcagtttatgcttgggtcttatgttggctggcaggggaaggaagatgtactgcgcgaacgattggatttgctggccgaaaaagtcaaaagattaccaaagccaaaatttgccggagaatggagtggtcatcgtatgtttctccatggtcagctgaaaagctggtcgtcgaatttcttccgtctttttaatgagacgcgggaacttctggaaagtatcaagagtgatattcaacatgccaccatgctcattagctatgtggaagagaaaggaggctatcatccacagctgttgagtcagtatcggaagttaatggaacaattaccggcgttgcggactaaggttttggatcctgagattgagatgacgcatatgtccgaggctgttcgaagttacattatgatacacaagtctgtagcgggatttctgccggatttactcgagtctttggatcgagataaggatagggaatttttgctttccatctttcctcgtattccaaagatagataagaagacgaaagagatcgttgcatgggagctaccgggcgagccagaggaaggctatttgttcacagcaaacaaccttttccggaattttcttgagaatccgaaacatgtgccacgatttatggcagagaggattcccgaggattggacgcgtttgcgctcggcccctgtgtggtttgatgggatggtgaagcaatggcagaaggtggtgaatcagttggttgaatctccaggcgccctttatcagttcaatgaaagttttttgcgtcaaagactgcaagcaatgcttacggtctataagcgggatctccagactgagaagtttctgaagctgctggctgatgtctgtcgtccactcgttgattttttcggacttggaggaaatgatattatcttcaagtcatgtcaggatccaagaaagcaatggcagactgttattccactcagtgtcccagcggatgtttatacagcatgtgaaggcttggctattcgtctccgcgaaactcttggattcgaatggaaaaatctgaaaggacacgagcgggaagattttttacggctgcatcagttgctgggaaatctgctgttctggatcagggatgcgaaacttgtcgtgaagctggaagactggatgaacaatccttgtgttcaggagtatgtggaagcacgaaaagccattgatcttcccttggagattttcggatttgaggtgccgatttttctcaatggctatctcttttcggaactgcgccagctggaattgttgctgaggcgtaagtcggtgatgacgtcttacagcgtcaaaacgacaggctcgccaaataggctcttccagttggtttacctacctctaaacccttcagatccggaaaagaaaaattccaacaactttcaggagcgcctcgatacacctaccggtttgtcgcgtcgttttctggatcttacgctggatgcatttgctggcaaactcttgacggatccggtaactcaggaactgaagacgatggccggtttttacgatcatctctttggcttcaagttgccgtgtaaactggcggcgatgagtaaccatccaggatcctcttccaaaatggtggttctggcaaaaccaaagaagggtgttgctagtaacatcggctttgaacctattcccgatcctgctcatcctgtgttccgggtgagaagttcctggccggagttgaagtacctggaggggttgttgtatcttcccgaagatacaccactgaccattgaactggcggaaacgtcggtcagttgtcagtctgtgagttcagtcgctttcgatttgaagaatctgacgactatcttgggtcgtgttggtgaattcagggtgacggcagatcaacctttcaagctgacgcccattattcctgagaaagaggaatccttcatcgggaagacctacctcggtcttgatgctggagagcgatctggcgttggtttcgcgattgtgacggttgacggcgatgggtatgaggtgcagaggttgggtgtgcatgaagatactcagcttatggcgcttcagcaagtcgccagcaagtctcttaaggagccggttttccagccactccgtaagggcacatttcgtcagcaggagcgcattcgcaaaagcctccgcggttgctactggaatttctatcatgcattgatgatcaagtaccgagctaaagttgtgcatgaggaatcggtgggttcatccggtctggtggggcagtggctgcgtgcatttcagaaggatctcaaaaaggctgatgttctgcccaagaagggtggaaaaaatggtgtagacaaaaaaaagagagaaagcagcgctcaggataccttatggggaggagctttctcgaagaaggaagagcagcagatagcctttgaggttcaggcagctggatcaagccagttttgtctgaagtgtggttggtggtttcagttggggatgcgggaagtaaatcgtgtgcaggagagtggcgtggtgctggactggaaccggtccattgtaaccttcctcatcgaatcctcaggagaaaaggtatatggtttcagtcctcagcaactggaaaaaggctttcgtcctgacatcgaaacgttcaaaaaaatggtaagggattttatgagaccccccatgtttgatcgcaaaggtcggccggccgcggcgtatgaaagattcgtactgggacgtcgtcaccgtcgttatcgctttgataaagtttttgaagagagatttggtcgcagtgctcttttcatctgcccgcgggtcgggtgtgggaatttcgatcactccagtgagcagtcagccgttgtccttgcccttattggttacattgctgataaggaagggatgagtggtaagaagcttgtttatgtgaggctggctgaacttatggctgagtggaagctgaagaaactggagagatcaagggtggaagaacagagctcggcacaataa

SEQ ID NO: 38 - DNA, 3579 bp, Artificial Sequence
  Description of Artificial Sequence: Synthetic polynucleotide
atggcagaaagcaagcagatgcaatgccgcaagtgcggcgcaagcatgaagtatgaagtaattggattgggcaagaagtcatgcagatatatgtgcccagattgcggcaatcacaccagcgcgcgcaagattcagaacaagaaaaagcgcgacaaaaagtatggatccgcaagcaaagcgcagagccagaggatagctgtggctggcgcgctttatccagacaaaaaagtgcagaccataaagacctacaaatacccagcggatcttaatggcgaagttcatgacagcggcgtcgcagagaagattgcgcaggcgattcaggaagatgagatcggcctgcttggcccgtccagcgaatacgcttgctggattgcttcacaaaaacagagcgagccgtattcagttgtagatttttggtttgacgcggtgtgcgcaggcggagtattcgcgtattctggcgcgcgcctgctttccacagtcctccagttgagtggcgaggaaagcgttttgcgcgctgctttagcatctagcccgtttgtagatgacattaatttggcgcaagcggaaaagttcctagccgttagccggcgcacaggccaagataagctaggcaagcgcattggagaatgttttgcggaaggccggcttgaagcgcttggcatcaaagatcgcatgcgcgaattcgtgcaagcgattgatgtggcccaaaccgcgggccagcggttcgcggccaagctaaagatattcggcatcagtcagatgcctgaagccaagcaatggaacaatgattccgggctcactgtatgtattttgccggattattatgtcccggaagaaaaccgcgcggaccagctggttgttttgcttcggcgcttacgcgagatcgcgtattgcatgggaattgaggatgaagcaggatttgagcatctaggcattgaccctggtgctctttccaatttttccaatggcaatccaaagcgaggatttctcggccgcctgctcaataatgacattatagcgctggcaaacaacatgtcagccatgacgccgtattgggaaggcagaaaaggcgagttgattgagcgccttgcatggcttaaacatcgcgctgaaggattgtatttgaaagagccacatttcggcaactcctgggcagaccaccgcagcaggattttcagtcgcattgcgggctggctttccggatgcgcgggcaagctcaagattgccaaggatcagatttcaggcgtgcgtacggatttgtttctgctcaagcgccttctggatgcggtaccgcaaagcgcgccgtcgccggactttattgcttccatcagcgcgctggatcggtttttggaagcggcagaaagcagccaggatccggcagaacaggtacgcgctttgtacgcgtttcatctgaacgcgcctgcggtccgatccatcgccaacaaggcggtacagaggtctgattcccaggagtggcttatcaaggaactggatgctgtagatcaccttgaattcaacaaagcatttccgtttttttcggatacaggaaagaaaaagaagaaaggagcgaatagcaacggagcgccttctgaagaagaatacacggaaacagaatccattcaacaaccagaagatgcagagcaggaagtgaatggtcaagaaggaaatggcgcttcaaagaaccagaaaaagtttcagcgcattcctcgatttttcggggaagggtcaaggagtgagtatcgaattttaacagaagcgccgcaatattttgacatgttctgcaataatatgcgcgcgatctttatgcagctagagagtcagccgcgcaaggcgcctcgtgatttcaaatgctttctgcagaatcgtttgcagaagctttacaagcaaacctttctcaatgctcgcagtaataaatgccgcgcgcttctggaatccgtccttatttcatggggagaattttatacttatggcgcgaatgaaaagaagtttcgtctgcgccatgaagcgagcgagcgcagctcggatccggactatgtggttcagcaggcattggaaatcgcgcgccggcttttcttgttcggatttgagtggcgcgattgctctgctggagagcgcgtggatttggttgaaatccacaaaaaagcaatctcatttttgcttgcaatcactcaggccgaggtttcagttggttcctataactggcttgggaatagcaccgtgagccggtatctttcggttgctggcacagacacattgtacggcactcaactggaggagtttttgaacgccacagtgctttcacagatgcgtgggctggcgattcggctttcatctcaggagttaaaagacggatttgatgttcagttggagagttcgtgccaggacaatctccagcatctgctggtgtatcgcgcttcgcgcgacttggctgcgtgcaaacgcgctacatgcccggctgaattggatccgaaaattcttgttctgccggttggtgcgtttatcgcgagcgtaatgaaaatgattgagcgtggcgatgaaccattagcaggcgcgtatttgcgtcatcggccgcattcattcggctggcagatacgggttcgtggagtggcggaagtaggcatggatcagggcacagcgctagcattccagaagccgactgaatcagagccgtttaaaataaagccgttttccgctcaatacggcccagtactttggcttaattcttcatcctatagccagagccagtatctggatggatttttaagccagccaaagaattggtctatgcgggtgctacctcaagccggatcagtgcgcgtggaacagcgcgttgctctgatatggaatttgcaggcaggcaagatgcggctggagcgctctggagcgcgcgcgtttttcatgccagtgccattcagcttcaggccgtctggttcaggagatgaagcagtattggcgccgaatcggtacttgggactttttccgcattccggaggaatagaatacgcggtggtggatgtattagattccgcgggtttcaaaattcttgagcgcggtacgattgcggtaaatggcttttcccagaagcgcggcgaacgccaagaggaggcacacagagaaaaacagagacgcggaatttctgatataggccgcaagaagccggtgcaagctgaagttgacgcagccaatgaattgcaccgcaaatacaccgatgttgccactcgtttagggtgcagaattgtggttcagtgggcgccccagccaaagccgggcacagcgccgaccgcgcaaacagtatacgcgcgcgcagtgcggaccgaagcgccgcgatctggaaatcaagaggatcatgctcgtatgaaatcctcttggggatatacctggggcacctattgggagaagcgcaaaccagaggatattttgggcatctcaacccaagtatactggaccggcggtataggcgagtcatgtcccgcagtcgcggttgcgcttttggggcacattagggcaacatccactcaaactgaatgggaaaaagaggaggttgtattcggtcgactgaagaagttctttccaagctag

SEQ ID NO: 39 - DNA, 2958 bp, Artificial Sequence
  Description of Artificial Sequence: Synthetic polynucleotide
atggaaaagagaataaacaagatacgaaagaaactatcggccgataatgccacaaagcctgtgagcaggagcggccccatgaaaacactccttgtccgggtcatgacggacgacttgaaaaaaagactggagaagcgtcggaaaaagccggaagttatgccgcaggttatttcaaataacgcagcaaacaatcttagaatgctccttgatgactatacaaagatgaaggaggcgatactacaagtttactggcaggaatttaaggacgaccatgtgggcttgatgtgcaaatttgcccagcctgcttccaaaaaaattgaccagaacaaactaaaaccggaaatggatgaaaaaggaaatctaacaactgccggttttgcatgttctcaatgcggtcagccgctatttgtttataagcttgaacaggtgagtgaaaaaggcaaggcttatacaaattacttcggccggtgtaatgtggccgagcatgagaaattgattcttcttgctcaattaaaacctgaaaaagacagtgacgaagcagtgacatactcccttggcaaattcggccagagggcattggacttttattcaatccacgtaacaaaagaatccacccatccagtaaagcccctggcacagattgcgggcaaccgctatgcaagcggacctgttggcaaggccctttccgatgcctgtatgggcactatagccagttttctttcgaaatatcaagacatcatcatagaacatcaaaaggttgtgaagggtaatcaaaagaggttagagagtctcagggaattggcagggaaagaaaatcttgagtacccatcggttacactgccgccgcagccgcatacgaaagaaggggttgacgcttataacgaagttattgcaagggtacgtatgtgggttaatcttaatctgtggcaaaagctgaagctcagccgtgatgacgcaaaaccgctactgcggctaaaaggattcccatctttccctgttgtggagcggcgtgaaaacgaagttgactggtggaatacgattaatgaagtaaaaaaactgattgacgctaaacgagatatgggacgggtattctggagcggcgttaccgcagaaaagagaaataccatccttgaaggatacaactatctgccaaatgagaatgaccataaaaagagagagggcagtttggaaaaccctaagaagcctgccaaacgccagtttggagacctcttgctgtatcttgaaaagaaatatgccggagactggggaaaggtcttcgatgaggcatgggagaggatagataagaaaatagccggactcacaagccatatagagcgcgaagaagcaagaaacgcggaagacgctcaatccaaagccgtacttacagactggctaagggcaaaggcatcatttgttcttgaaagactgaaggaaatggatgaaaaggaattctatgcgtgtgaaatccaacttcaaaaatggtatggcgatcttcgaggcaacccgtttgccgttgaagctgagaatagagttgttgatataagcgggttttctatcggaagcgatggccattcaatccaatacagaaatctccttgcctggaaatatctggagaacggcaagcgtgaattctatctgttaatgaattatggcaagaaagggcgcatcagatttacagatggaacagatattaaaaagagcggcaaatggcagggactattatatggcggtggcaaggcaaaggttattgatctgactttcgaccccgatgatgaacagttgataatcctgccgctggcctttggcacaaggcaaggccgcgagtttatctggaacgatttgctgagtcttgaaacaggcctgataaagctcgcaaacggaagagttatcgaaaaaacaatctataacaaaaaaatagggcgggatgaaccggctctattcgttgccttaacatttgagcgccgggaagttgttgatccatcaaatataaagcctgtaaaccttataggcgttgaccgcggcgaaaacatcccggcggttattgcattgacagaccctgaaggttgtcctttaccggaattcaaggattcatcagggggcccaacagacatcctgcgaataggagaaggatataaggaaaagcagagggctattcaggcagcaaaggaggtagagcaaaggcgggctggcggttattcacggaagtttgcatccaagtcgaggaacctggcggacgacatggtgagaaattcagcgcgagaccttttttaccatgccgttacccacgatgccgtccttgtctttgaaaacctgagcaggggttttggaaggcagggcaaaaggaccttcatgacggaaagacaatatacaaagatggaagactggctgacagcgaagctcgcatacgaaggtcttacgtcaaaaacctacctttcaaagacgctggcgcaatatacgtcaaaaacatgctccaactgcgggtttactataacgactgccgattatgacgggatgttggtaaggcttaaaaagacttctgatggatgggcaactaccctcaacaacaaagaattaaaagccgaaggccagataacgtattataaccggtataaaaggcaaaccgtggaaaaagaactctccgcagagcttgacaggctttcagaagagtcgggcaataatgatatttctaagtggaccaagggtcgccgggacgaggcattatttttgttaaagaaaagattcagccatcggcctgttcaggaacagtttgtttgcctcgattgcggccatgaagtccacgccgatgaacaggcagccttgaatattgcaaggtcatggctttttctaaactcaaattcaacagaattcaaaagttataaatcgggtaaacagcccttcgttggtgcttggcaggccttttacaaaaggaggcttaaagaggtatggaagcccaacgcc

SEQ ID NO: 40 - DNA, 2919 bp, Artificial Sequence
  Description of Artificial Sequence: Synthetic polynucleotide
atgaaaaggataaataaaatacgaaggagattggtaaaggatagcaacacgaaaaaagccggcaaaaccggccctatgaaaaccttgctcgttcgggttatgacacctgacctgagagaaaggttagagaatcttcgcaaaaagccggaaaacattcctcagcccatttcaaatacttcacgtgcaaatttaaataaactcctcactgactatacggaaatgaagaaagcaatcctgcatgtttattgggaagagttccaaaaagaccctgtcggattgatgagcagggttgcacaaccagcgcccaagaatattgatcagagaaaattgattccggtgaaggacggaaatgagagactaacaagttctggatttgcctgttctcagtgctgtcaacccctctatgtttataagcttgaacaagtgaatgacaagggtaagccccatacaaattactttggccgttgtaatgtctccgagcatgaacgtttgatattgctctcgccgcataaaccggaggcaaatgacgagctagtaacgtattcgttggggaagttcggtcaaagggcattggacttttattcaatccacgtaacaagagaatcgaaccatcctgtaaagccgctagaacagatcggtggcaatagctgcgcaagtggtcccgttggtaaggctttatctgatgcctgtatgggagcagtagccagtttccttacaaagtaccaggacatcatcctcgaacaccaaaaggttataaaaaaaaacgaaaagagattggcaaatctaaaggatatagcaagtgcaaacgggcttgcatttcctaaaatcactcttccaccgcaaccgcatacaaaagaagggattgaagcttataacaatgttgttgctcagatagtgatctgggtaaacctgaatctttggcagaaactcaaaattggcagggatgaggcaaagcccttacagcggcttaagggttttccgtccttccctcttgttgaacgccaggcgaatgaggttgattggtgggatatggtctgtaatgtcaaaaagttgattaacgaaaagaaagaggacgggaaggtcttctggcaaaatcttgctggatataaaaggcaggaagccttgcttccatatctttcgtctgaagaagaccgtaaaaaaggaaaaaagtttgcgcgttatcagtttggtgaccttttgcttcaccttgaaaagaaacacggtgaagattggggcaaagtttatgatgaggcatgggaaagaatagataaaaaagttgaaggtctgagtaagcacataaagttggaggaagaaagaaggtctgaagatgctcaatcaaaggctgccctcactgattggctcagggcaaaggcctcttttgttattgaagggctcaaagaagctgataaggatgagttttgcaggtgtgagttaaagcttcaaaagtggtatggagatttgagaggaaaaccatttgctatagaagcagagaacagcattttagatataagcggattttctaaacagtataattgtgcatttatatggcagaaagacggcgtaaagaagttaaatctttatttaataataaattacttcaaaggtggtaagctacgcttcaaaaaaatcaagccagaagcttttgaagcaaataggttttatacagtaattaataaaaaaagcggtgagattgtgcctatggaggtcaacttcaattttgatgacccgaatttgataattctgcctttggcctttggaaaaaggcaggggagggagtttatctggaacgacctattgagccttgagacgggttcattgaaactcgccaatggcagggttattgaaaaaacgctctataacagaaggacgagacaggatgaaccagcactttttgttgccctgacatttgaaagaagagaggtgcttgactcatcgaatataaaaccgatgaatctgataggaatagaccggggagaaaatatcccggcagtcatagcattaacagacccggaaggatgccccttgtcaagattcaaagattcattgggcaatccaacgcatattttgcgaataggagaaagttataaggaaaaacaacggactattcaggctgctaaagaagttgaacaaaggcgggcaggcggatattcgagaaaatatgcatcaaaggcgaagaatctggcggacgatatggtaagaaatacagctcgtgacctcttatattatgctgttactcaagatgcaatgctcatttttgaaaatctttcccgcggttttggtagacaaggcaagaggacttttatggcggaaaggcagtacacgaggatggaagactggctgactgcaaagcttgcctatgaaggtctgccatcaaaaacctatctttcaaagactctggcacagtatacctcaaagacatgttctaattgtggttttacaatcacaagtgcagattatgacagggtgctcgaaaagctcaagaagacggctactggatggatgactacaatcaatggaaaagagttaaaagttgaaggacagataacatactataaccggtataaaaggcagaatgtggtaaaagacctctctgtagagctggatagactttcggaagagtcggtaaataatgatatttctagttggacaaaaggccgcagtggtgaagctttatctctgctaaaaaagagatttagtcacaggccggtgcaggaaaagtttgtttgcctgaactgtggttttgaaacccatgcagacgaacaagcagcactgaatattgcaaggtcgtggctctttctccgttctcaagaatataagaagtatcaaaccaataaaacgaccggaaatactgacaaaagggcatttgttgaaacatggcaatccttttacagaaagaagctcaaagaagtatggaaacca

SEQ ID NO: 41 - DNA, 4077 bp, Artificial Sequence
  Description of Artificial Sequence: Synthetic polynucleotide
atgggtaaaatgtattaccttggtttagacattggcacgaattccgtgggctacgcggtgaccgacccctcataccacctgctgaagtttaagggggaaccaatgtggggtgcgcacgtatttgccgccggtaatcagagcgcggaacgacgctcgttccgcacatcgcgtcgtcgtttggaccgacgccaacagcgcgttaaactggtacaggagatttttgccccggtgattagtccgatcgacccacgcttcttcattcgtctgcatgaatccgccctgtggcgcgatgacgtcgcggagacggataaacatatctttttcaatgatcctacctataccgataaggaatattatagcgattacccgactatccatcacctgatcgttgatctgatggaaagctctgagaaacacgatccgcggctggtgtaccttgcagtggcgtggttagtggcacaccgtggtcattttctgaacgaggtggacaaggataatattggagatgtgttgtcgttcgacgcattttatccggagtttctcgcgttcctgtcggacaacggtgtatcaccgtgggtgtgcgaaagcaaagcgctgcaggcgaccttgctgagccgtaactcagtgaacgacaaatataaagcccttaagtctctgatcttcggatcccagaaacctgaagataacttcgatgccaatatttcggaagatggactcattcaactgctggccggcaaaaaggtaaaagttaacaaactgttccctcaggaatcgaacgatgcatccttcacattgaatgataaagaagacgcgatagaagaaatcctgggtacgcttacaccagatgaatgtgaatggattgcgcatatacgccgcctttttgactgggctatcatgaaacatgctctgaaagatggcaggactattagcgagtcaaaagtcaaactgtatgagcagcaccatcacgatctgacccaacttaaatacttcgtgaaaacctaccttgcaaaagaatacgacgatattttccgcaacgtggatagcgaaacaacgaaaaactatgtagcgtattcctatcatgtgaaagaggtgaaaggcactctgcctaaaaataaggcaacgcaagaagagttttgtaagtatgtcctgggcaaggttaaaaacattgaatgctctgaagcagacaaggttgactttgatgagatgattcagcgtcttaccgacaactcttttatgcctaagcaggtttcgggcgaaaaccgcgttattccttatcagttatattattatgaactgaagacaattctgaataaagcagcctcgtacctgcctttcctgacgcagtgtggaaaagatgcaatttcgaaccaggacaaactactgtcgatcatgacgttccgtattccttacttcgtcggacccttgcgaaaagataattcggaacatgcatggctcgaacgaaaggccggtaagatttatccgtggaactttaacgacaaagtggacttggataaatcagaagaagcgttcattcgccgaatgaccaatacctgtacctattatcccggcgaagatgttttaccgttggattcgctgatctatgagaaatttatgattttaaatgaaatcaataatattcgtattgacggctacccgattagtgttgacgttaaacagcaggtttttggcttgttcgaaaaaaaacgacgcgtaaccgtgaaagatattcagaacctgctgctgtctctcggagctctggacaaacacgggaagctgacaggcatcgataccactatccactcaaactataatacgtatcaccattttaaatctctcatggaacgcggcgtcctgacccgggatgacgtggaacgcatcgttgaaaggatgacctacagcgacgatactaagcgtgtgcgtctgtggctgaataacaactatggtactttaaccgccgacgatgtgaaacacatttcgcgtctgcgcaaacacgattttggccgtttatccaaaatgttcttaacaggtctgaagggtgtccataaggagaccggtgaacgtgcctccatactggatttcatgtggaacacgaacgataacctgatgcagctcctttccgaatgctacacgttcagtgatgaaatcacaaagctgcaagaggcgtattatgcaaaagcccagttgtctttaaacgattttttagactcgatgtacatctctaacgcggtgaaacgtccgatttacagaactctggcagtggtgaacgatattcgaaaagcatgtgggacggcccctaaacgcattttcatcgaaatggctcgtgatggtgaatcaaaaaaaaagagaagtgttacacgtcgcgagcagatcaaaaacctgtaccgctcgattcgtaaagatttccagcaggaagttgattttctggaaaagatcctggaaaataaatctgatggtcaacttcagtcagatgctttgtatctttactttgcacaattagggcgcgatatgtacacgggcgatccaataaagctggagcacatcaaagatcagagtttctataacatagaccatatttacccgcagtctatggtgaaagacgattccctagataacaaagtgctggtgcaaagcgaaattaacggcgagaaaagctcgcgataccctttggacgccgcgatccgcaataaaatgaagcccctttgggacgcttactataatcatggcctgatctccttaaagaaataccagcgtctaacgcgctcgaccccgtttaccgatgatgaaaaatgggactttattaatcgccagttagtggaaacccgtcaatctaccaaagcgctggccattttgttgaagcgtaagtttccagacaccgaaattgtgtattcgaaggcggggttatcgtccgacttcagacatgaattcggccttgtaaaaagtcgcaatattaatgatttgcaccacgctaaagacgcattcttggctatcgttaccggcaatgtgtaccatgaaagattcaatcgcagatggtttatggtgaaccagccgtactcagttaaaactaaaactctttttacccacagcataaagaatggcaacttcgttgcctggaacggcgaagaagatctcggtcgtattgtaaaaatgctgaagcaaaacaaaaataccattcacttcacgcgcttctccttcgatcgcaaagaaggattatttgatatccaacctctgaaagccagcaccggcttagtcccacgaaaagccggtctggatgtcgttaaatacggcggatatgacaaatctaccgcggcctattacctgctggtgaggttcacgctcgaggacaagaaaacccagcacaagctgatgatgattcctgtagaaggcctgtacaaggctcgcattgatcatgacaaggaatttcttaccgattatgcgcaaacgactataagcgaaatcctacagaaagataaacagaaagtgatcaatattatgtttccaatgggtacgaggcatataaaactcaattcaatgattagtatcgatggcttctatcttagtatcggcggaaagtcctctaaaggtaagtcagttctatgtcacgcaatggttccactgatcgtccctcacaaaatcgaatgttacattaaagcaatggaaagcttcgcccggaagtttaaagaaaacaacaagctgcgcatcgtagaaaaattcgataaaatcaccgttgaagacaacctgaatctctacgagctctttctccaaaaactgcagcataatccctataataagtttttttcgacacagtttgacgtactgacgaacggccgttctactttcacaaaactgtcgccggaggaacaggtacagacgctcttgaacattttaagtatctttaaaacatgccgcagttcgggttgcgacctgaaatccatcaacggcagtgcccaggcagcgcgcatcatgattagcgctgacttaactggactgtcgaaaaaatattcagatattaggttggttgaacagtcagcttctggtttgttcgtatccaaaagtcagaacttactggagtatctctaa

SEQ ID NO: 42 - DNA, 4005 bp, Artificial Sequence
  Description of Artificial Sequence: Synthetic polynucleotide
atgtcatcgctcacgaaattcactaacaaatactctaaacagctcaccattaagaatgaactcatcccagttggcaaaacactggagaacatcaaagagaatggtctgatagatggcgacgaacagctgaatgagaattatcagaaggcgaaaattattgtggatgattttctgcgggacttcattaataaagcactgaataatacgcagatcgggaactggcgcgaactggcggatgcccttaataaagaggatgaagataacatcgagaaattgcaggataaaattcggggaatcattgtatccaaatttgaaacgtttgatctgtttagcagctattctattaagaaagatgaaaagattattgacgacgacaatgatgttgaagaagaggaactggatctgggcaagaagaccagctcatttaaatacatatttaaaaaaaacctgtttaagttagtgttgccatcctacctgaaaaccacaaaccaggacaagctgaagattattagctcgtttgataatttttcaacgtacttccgcgggttctttgaaaaccggaaaaacatttttaccaagaaaccgatctccacaagtattgcgtatcgcattgttcatgataacttcccgaaattccttgataacattcgttgttttaatgtgtggcagacggaatgcccgcaactaatcgtgaaagcagataactatctgaaaagcaaaaatgttatagcgaaagataaaagtttggcaaactattttaccgtgggcgcgtatgactatttcctgtctcagaatggtatagatttttacaacaatattataggtggactgccagcgttcgccggccatgagaaaatccaaggtctcaatgaattcatcaatcaagagtgccaaaaagacagcgagctgaaaagtaagctgaaaaaccgtcacgcgttcaaaatggcggtactgttcaaacagatactcagcgatcgtgaaaaaagttttgtaattgatgagttcgagtcggatgctcaagttattgacgccgttaaaaacttttacgccgaacagtgcaaagataacaatgttatttttaacttattaaatcttatcaagaatatcgctttcttaagtgatgacgaactggacggcatattcattgaagggaaatacctgtcgagcgttagtcaaaaactctatagcgattggtcaaaattacgtaacgacattgaggattcggctaactctaaacaaggcaataaagagctggccaagaagatcaaaaccaacaaaggggatgtagaaaaagcgatctcgaaatatgagttctcgctgtcggaactgaactcgattgtacatgataacaccaagttttctgacctccttagttgtacactgcataaggtggcttctgagaaactggtgaaggtcaatgaaggcgactggccgaaacatctcaagaataatgaagagaaacaaaaaatcaaagagccgcttgatgctctgctggagatctataatacacttctgatttttaactgcaaaagcttcaataaaaacggcaacttctatgtcgactatgatcgttgcatcaatgaactgagttcggtcgtgtatctgtataataaaacacgtaactattgcactaaaaaaccctataacacggacaagttcaaactcaattttaacagtccgcagctcggtgaaggcttttccaagtcgaaagaaaatgactgtctgactcttttgtttaaaaaagacgacaactattatgtaggcattatccgcaaaggtgcaaaaatcaattttgatgatacacaagcaatcgccgataacaccgacaattgcatctttaaaatgaattatttcctacttaaagacgcaaaaaaatttatcccgaaatgtagcattcagctgaaagaagtcaaggcccattttaagaaatctgaagatgattacattttgtctgataaagagaaatttgctagcccgctggtcattaaaaagagcacatttttgctggcaactgcacatgtgaaagggaaaaaaggcaatatcaagaaatttcagaaagaatattcgaaagaaaaccccactgagtatcgcaattctttaaacgaatggattgctttttgtaaagagttcttaaaaacttataaagcggctaccatttttgatataaccacattgaaaaaggcagaggaatatgctgatattgtagaattctacaaggatgtcgataatctgtgctacaaactggagttctgcccgattaaaacctcgtttatagaaaacctgatagataacggcgacctgtatctgtttcgcatcaataacaaagacttcagcagtaaatcgaccggcaccaagaaccttcatacgttatatttacaagctatattcgatgaacgtaatctgaacaatccgacaattatgctgaatgggggagcagaactgttctatcgtaaagaaagtattgagcagaaaaaccgtatcacacacaaagccggttcaattctcgtgaataaggtgtgtaaagacggtacaagcctggatgataagatacgtaatgaaatttatcaatatgagaataaatttattgataccctgtctgatgaagctaaaaaggtgttaccgaatgtcattaaaaaggaagctacccatgacattacaaaagataaacgtttcactagtgacaaattcttctttcactgccccctgacaattaattataaggaaggcgataccaagcagttcaataacgaagtgctgagttttctgcgtggaaatcctgacatcaacattatcggcattgaccgcggagagcgtaatttaatctatgtaacggttataaaccagaaaggcgagattctggattcggtttcattcaataccgtgaccaacaagagttcaaaaatcgagcagacagtcgattatgaagagaaattggcagtccgcgagaaagagaggattgaagcaaaacgttcctgggactctatctcaaaaattgcgacactaaaggaaggttatctgagcgcaatagttcacgagatctgtctgttaatgattaaacacaacgcgatcgttgtcttagagaatcttaatgcaggctttaagcgtattcgtggcggtttatcagaaaaaagtgtttatcaaaaattcgaaaaaatgttgattaacaaactgaactattttgtcagcaagaaggaatccgactggaataaaccgtctggtctgctgaatggactgcagctttcggatcagtttgaaagcttcgaaaaactgggtattcagtctggttttattttttacgtgccggctgcatatacctcaaagattgatccgaccacgggcttcgccaatgttctgaatctgtcgaaggtacgcaatgttgatgcgatcaaaagctttttttctaacttcaacgaaattagttatagcaagaaagaagcccttttcaaattctcattcgatctggattcactgagtaagaaaggctttagtagctttgtgaaatttagtaagagtaaatggaacgtctacacctttggagaacgtatcataaagccaaagaataagcaaggttatcgggaggacaaaagaatcaacttgaccttcgagatgaagaagttacttaacgagtataaggtttcttttgatcttgaaaataacttgattccgaatctcacgagtgccaacctgaaggatactttttggaaagagctattctttatcttcaagactacgctgcagctccgtaacagcgttactaacggtaaagaagatgtgctcatctctccggtcaaaaatgcgaagggtgaattcttcgtttcgggaacgcataacaagactcttccgcaagattgcgatgcgaacggtgcataccatattgcgttgaaaggtctgatgatactcgaacgtaacaaccttgtacgtgaggagaaagatacgaaaaagattatggcgatttcaaacgtggattggttcgagtacgtgcagaaacgtagaggcgttctgtaa

SEQ ID NO: 43 - DNA, 3717 bp, Artificial Sequence
  Description of Artificial Sequence: Synthetic polynucleotide
atgaacaactacgacgaattcaccaaactgtacccgatccagaaaaccatccgtttcgaactgaaaccgcagggtcgtaccatggaacacctggaaaccttcaacttcttcgaagaagaccgtgaccgtgcggaaaaatacaaaatcctgaaagaagcgatcgacgaataccacaaaaaattcatcgacgaacacctgaccaacatgtctctggactggaactctctgaaacagatctctgaaaaatactacaaatctcgtgaagaaaaagacaaaaaagttttcctgtctgaacagaaacgtatgcgtcaggaaatcgtttctgaattcaaaaaagacgaccgtttcaaagacctgttctctaaaaaactgttctctgaactgctgaaagaagaaatctacaaaaaaggtaaccaccaggaaatcgacgcgctgaaatctttcgacaaattctctggttacttcatcggtctgcacgaaaaccgtaaaaacatgtactctgacggtgacgaaatcaccgcgatctctaaccgtatcgttaacgaaaacttcccgaaattcctggacaacctgcagaaataccaggaagcgcgtaaaaaatacccggaatggatcatcaaagcggaatctgcgctggttgcgcacaacatcaaaatggacgaagttttctctctggaatacttcaacaaagttctgaaccaggaaggtatccagcgttacaacctggcgctgggtggttacgttaccaaatctggtgaaaaaatgatgggtctgaacgacgcgctgaacctggcgcaccagtctgaaaaatcttctaaaggtcgtatccacatgaccccgctgttcaaacagatcctgtctgaaaaagaatctttctcttacatcccggacgttttcaccgaagactctcagctgctgccgtctatcggtggtttcttcgcgcagatcgaaaacgacaaagacggtaacatcttcgaccgtgcgctggaactgatctcttcttacgcggaatacgacaccgaacgtatctacatccgtcaggcggacatcaaccgtgtttctaacgttatcttcggtgaatggggtaccctgggtggtctgatgcgtgaatacaaagcggactctatcaacgacatcaacctggaacgtacctgcaaaaaagttgacaaatggctggactctaaagaattcgcgctgtctgacgttctggaagcgatcaaacgtaccggtaacaacgacgcgttcaacgaatacatctctaaaatgcgtaccgcgcgtgaaaaaatcgacgcggcgcgtaaagaaatgaaattcatctctgaaaaaatctctggtgacgaagaatctatccacatcatcaaaaccctgctggactctgttcagcagttcctgcacttcttcaacctgttcaaagcgcgtcaggacatcccgctggacggtgcgttctacgcggaattcgacgaagttcactctaaactgttcgcgatcgttccgctgtacaacaaagttcgtaactacctgaccaaaaacaacctgaacaccaaaaaaatcaaactgaacttcaaaaacccgaccctggcgaacggttgggaccagaacaaagtttacgactacgcgtctctgatcttcctgcgtgacggtaactactacctgggtatcatcaacccgaaacgtaaaaaaaacatcaaattcgaacagggttctggtaacggtccgttctaccgtaaaatggtttacaaacagatcccgggtccgaacaaaaacctgccgcgtgttttcctgacctctaccaaaggtaaaaaagaatacaaaccgtctaaagaaatcatcgaaggttacgaagcggacaaacacatccgtggtgacaaattcgacctggacttctgccacaaactgatcgacttcttcaaagaatctatcgaaaaacacaaagactggtctaaattcaacttctacttctctccgaccgaatcttacggtgacatctctgaattctacctggacgttgaaaaacagggttaccgtatgcacttcgaaaacatctctgcggaaaccatcgacgaatacgttgaaaaaggtgacctgttcctgttccagatctacaacaaagacttcgttaaagcggcgaccggtaaaaaagacatgcacaccatctactggaacgcggcgttctctccggaaaacctgcaggacgttgttgttaaactgaacggtgaagcggaactgttctaccgtgacaaatctgacatcaaagaaatcgttcaccgtgaaggtgaaatcctggttaaccgtacctacaacggtcgtaccccggttccggacaaaatccacaaaaaactgaccgactaccacaacggtcgtaccaaagacctgggtgaagcgaaagaatacctggacaaagttcgttacttcaaagcgcactacgacatcaccaaagaccgtcgttacctgaacgacaaaatctacttccacgttccgctgaccctgaacttcaaagcgaacggtaaaaaaaacctgaacaaaatggttatcgaaaaattcctgtctgacgaaaaagcgcacatcatcggtatcgaccgtggtgaacgtaacctgctgtactactctatcatcgaccgttctggtaaaatcatcgaccagcagtctctgaacgttatcgacggtttcgactaccgtgaaaaactgaaccagcgtgaaatcgaaatgaaagacgcgcgtcagtcttggaacgcgatcggtaaaatcaaagacctgaaagaaggttacctgtctaaagcggttcacgaaatcaccaaaatggcgatccagtacaacgcgatcgttgttatggaagaactgaactacggtttcaaacgtggtcgtttcaaagttgaaaaacagatctaccagaaattcgaaaacatgctgatcgacaaaatgaactacctggttttcaaagacgcgccggacgaatctccgggtggtgttctgaacgcgtaccagctgaccaacccgctggaatctttcgcgaaactgggtaaacagaccggtatcctgttctacgttccggcggcgtacacctctaaaatcgacccgaccaccggtttcgttaacctgttcaacacctcttctaaaaccaacgcgcaggaacgtaaagaattcctgcagaaattcgaatctatctcttactctgcgaaagacggtggtatcttcgcgttcgcgttcgactaccgtaaattcggtacctctaaaaccgaccacaaaaacgtttggaccgcgtacaccaacggtgaacgtatgcgttacatcaaagaaaaaaaacgtaacgaactgttcgacccgtctaaagaaatcaaagaagcgctgacctcttctggtatcaaatacgacggtggtcagaacatcctgccggacatcctgcgttctaacaacaacggtctgatctacaccatgtactcttctttcatcgcggcgatccagatgcgtgtttacgacggtaaagaagactacatcatctctccgatcaaaaactctaaaggtgaattcttccgtaccgacccgaaacgtcgtgaactgccgatcgacgcggacgcgaacggtgcgtacaacatcgcgctgcgtggtgaactgaccatgcgtgcgatcgcggaaaaattcgacccggactctgaaaaaatggcgaaactggaactgaaacacaaagactggttcgaattcatgcagacccgtggtgactaa

SEQ ID NO: 44 - DNA, 3897 bp, Artificial Sequence
  Description of Artificial Sequence: Synthetic polynucleotide
atgactaaaacatttgattcagagttttttaatttgtactcgctgcaaaaaacggtacgctttgagttaaaacccgtgggagaaaccgcgtcatttgtggaagactttaaaaacgagggcttgaaacgtgttgtgagcgaagatgaaaggcgagccgtcgattaccagaaagttaaggaaataattgacgattaccatcgggatttcattgaagaaagtttaaattattttccggaacaggtgagtaaagatgctcttgagcaggcgtttcatctttatcagaaactgaaggcagcaaaagttgaggaaagggaaaaagcgctgaaagaatgggaagcgctgcagaaaaagctacgtgaaaaagtggtgaaatgcttctcggactcgaataaagcccgcttctcaaggattgataaaaaggaactgattaaggaagacctgataaattggttggtcgcccagaatcgcgaggatgatatccctacggtcgaaacgtttaacaacttcaccacatattttaccggcttccatgagaatcgtaaaaatatttactccaaagatgatcacgccaccgctattagctttcgccttattcatgaaaatcttccaaagttttttgacaacgtgattagcttcaataagttgaaagagggtttccctgaattaaaatttgataaagtgaaagaggatttagaagtagattatgatctgaagcatgcgtttgaaatagaatatttcgttaacttcgtgacccaagcgggcatagatcagtataattatctgttaggagggaaaaccctggaggacgggacgaaaaaacaagggatgaatgagcaaattaatctgttcaaacaacagcaaacgcgagataaagcgcgtcagattcccaaactgatccccctgttcaaacagattcttagcgaaaggactgaaagccagtcctttattcctaaacaatttgaaagtgatcaggagttgttcgattcactgcagaagttacataataactgccaggataaattcaccgtgctgcaacaagccattctcggtctggcagaggcggatcttaagaaggtcttcatcaaaacctctgatttaaatgccttatctaacaccattttcgggaattacagcgtcttttccgatgcactgaacctgtataaagaaagcctgaaaacgaaaaaagcgcaggaggcttttgagaaactaccggcccattctattcacgacctcattcaatacttggaacagttcaattccagcctggacgcggaaaaacaacagagcaccgacaccgtcctgaactacttcatcaagaccgatgaattatattctcgcttcattaaatccactagcgaggctttcactcaggtgcagcctttgttcgaactggaagccctgtcatctaagcgccgcccaccggaatcggaagatgaaggggcaaaagggcaggaaggcttcgagcagatcaagcgtattaaagcttacctggatacgcttatggaagcggtacactttgcaaagccgttgtatcttgttaagggtcgtaaaatgatcgaagggctcgataaagaccagtccttttatgaagcgtttgaaatggcgtaccaagaacttgaatcgttaatcattcctatctataacaaagcgcggagctatctgtcgcggaaacctttcaaggccgataaattcaagattaattttgacaacaacacgctactgagcggatgggatgcgaacaaggaaactgctaacgcgtccattctgtttaagaaagacgggttatattaccttggaattatgccgaaaggtaagacctttctctttgactactttgtatcgagcgaggattcagagaaactgaaacagcgtcgccagaagaccgccgaagaagctctggcgcaggatggtgaaagttacttcgaaaaaattcgttataaactgttaccaggggcttcaaagatgttaccgaaagtcttttttagcaacaaaaatattggcttttacaacccgtcggatgacattttacgcattcgcaacacagcctctcacaccaaaaacgggacccctcagaaaggccactcaaaagttgagtttaacctgaatgattgtcataagatgattgatttcttcaaatcatcaattcagaaacacccggaatgggggtcttttggctttacgttttctgataccagtgattttgaagacatgagtgccttctaccgggaagtagaaaaccagggttacgtaattagctttgacaaaatcaaagagacctatatacagagccaggtggaacagggtaatctctacttattccagatttataacaaggatttctcgccctacagcaaaggcaaaccaaacctgcatactctgtactggaaagccctgtttgaagaagcgaacctgaataacgtagtggcgaagttgaacggtgaagcggaaatcttcttccgtcgtcactccattaaggcctctgataaagttgtccatccggcaaatcaggccattgataataagaatccacacacggaaaaaacgcagtcaacctttgaatatgacctcgttaaagacaaacgctacacgcaagataagttctttttccacgtcccaatcagcctcaactttaaagcacaaggggtttcaaagtttaatgataaagtcaatgggttcctcaagggcaacccggatgtcaacattataggtatagacaggggcgaacgccatctgctttactttaccgtagtgaatcagaaaggtgaaatactggttcaggaatcattaaataccttgatgtcggacaaagggcacgttaatgattaccagcagaaactggataaaaaagaacaggaacgtgatgctgcgcgtaaatcgtggaccacggttgagaacattaaagagctgaaagaggggtatctaagccatgtggtacacaaactggcgcacctcatcattaaatataacgcaatagtctgcctagaagacttgaattttggctttaaacgcggccgcttcaaagtggaaaaacaagtttatcaaaaatttgaaaaggcgcttatagataaactgaattatctggtttttaaagaaaaggaacttggtgaggtagggcactacttgacagcttatcaactgacggccccgttcgaatcattcaaaaaactgggcaaacagtctggcattctgttttacgtgccggcagattatacttcaaaaatcgatccaacaactggctttgtgaacttcctggacctgagatatcagtctgtagaaaaagctaaacaacttcttagcgattttaatgccattcgttttaacagcgttcagaattactttgaattcgaaattgactataaaaaacttactccgaaacgtaaagtcggaacccaaagtaaatgggtaatttgtacgtatggcgatgtcaggtatcagaaccgtcggaatcaaaaaggtcattgggagaccgaagaagtgaacgtgaccgaaaagctgaaggctctgttcgccagcgattcaaaaactacaactgtgatcgattacgcaaatgatgataacctgatagatgtgattttagagcaggataaagccagcttttttaaagaactgttgtggctcctgaaacttacgatgaccttacgacattccaagatcaaatcggaagatgattttattctgtcaccggtcaagaatgagcagggtgaattctatgatagtaggaaagccggcgaagtgtggccgaaagacgccgacgccaatggcgcctatcatatcgcgctcaaagggctttggaatttgcagcagattaaccagtgggaaaaaggtaaaaccctgaatctggctatcaaaaaccaggattggtttagctttatccaagagaaaccgtatcaggaatga

SEQ ID NO: 45 - DNA, 3708 bp, Artificial Sequence
  Description of Artificial Sequence: Synthetic polynucleotide
atgcatacaggcggtcttcttagtatggacgcgaaagagttcacaggtcagtatccgttgtcgaaaacattacgattcgaacttcggcccatcggccgcacgtgggataacctggaggcctcaggctacttagcggaagaccgccatcgtgccgaatgttatcctcgtgcgaaagagttattggatgacaaccatcgtgccttcctgaatcgtgtgttgccacaaatcgatatggattggcacccgattgcggaggccttttgtaaggtacataaaaaccctggtaataaagaacttgcccaggattacaaccttcagttgtcaaagcgccgtaaggagatcagcgcatatcttcaggatgcagatggctataaaggcctgttcgcgaagcccgccttagacgaagctatgaaaattgcgaaagaaaacgggaacgaaagtgatattgaggttctcgaagcgtttaacggttttagcgtatacttcaccggttatcatgagtcacgcgagaacatttatagcgatgaggatatggtgagcgtagcctaccgaattactgaggataatttcccgcgctttgtctcaaacgctttgatctttgataaattaaacgaaagccatccggatattatctctgaagtatcgggcaatcttggagttgatgacattggtaagtactttgacgtgtcgaactataacaattttctttcccaggccggtatagatgactacaatcacattattggcggccatacaaccgaagacggactgatacaagcgtttaatgtcgtattgaacttacgtcaccaaaaagaccctggctttgaaaaaattcagttcaaacagctctacaaacaaatcctgagcgtgcgtaccagcaaaagctacatcccgaaacagtttgacaactctaaggagatggttgactgcatttgcgattatgtcagcaaaatagagaaatccgaaacagtagaacgggccctgaaactagtccgtaatatcagttctttcgacttgcgcgggatctttgtcaataaaaagaacttgcgcatactgagcaacaaactgataggagattgggacgcgatcgaaaccgcattgatgcatagttcttcatcagaaaacgataagaaaagcgtatatgatagcgcggaggcttttacgttggatgacatcttttcaagcgtgaaaaaattttctgatgcctctgccgaagatattggcaacagggcggaagacatctgtagagtgataagtgagacggccccttttatcaacgatctgcgagcggtggacctggatagcctgaacgacgatggttatgaagcggccgtctcaaaaattcgggagtcgctggagccttatatggatcttttccatgaactggaaattttctcggttggcgatgagttcccaaaatgcgcagcattttacagcgaactggaggaagtcagcgaacagctgatcgaaattattccgttattcaacaaggcgcgttcgttctgcacccggaaacgctatagcaccgataagattaaagtgaacttaaaattcccgaccttggcggacgggtgggacctgaacaaagagagagacaacaaagccgcgattctgcggaaagacggtaagtattatctggcaattctggatatgaagaaagatctgtcaagcattaggaccagcgacgaagatgaatccagcttcgaaaagatggagtataaactgttaccgagtccagtaaaaatgctgccaaagatattcgtaaaatcgaaagccgctaaggaaaaatatggcctgacagatcgtatgcttgaatgctacgataaaggtatgcataagtcgggtagtgcgtttgatcttggcttttgccatgaactcattgattattacaagcgttgtatcgcggagtacccaggctgggatgtgttcgatttcaagtttcgcgaaacttccgattatgggtccatgaaagagttcaatgaagatgtggccggagccggttactatatgagtctgagaaaaattccgtgcagcgaagtgtaccgtctgttagacgagaaatcgatttatctatttcaaatttataacaaagattactctgaaaatgcacatggtaataagaacatgcataccatgtactgggagggtctcttttccccgcaaaacctggagtcgcccgttttcaagttgtcgggtggggcagaacttttctttcgaaaatcctcaatccctaacgatgccaaaacagtacacccgaaaggctcagtgctggttccacgtaatgatgttaacggtcggcgtattccagattcaatctaccgcgaactgacacgctattttaaccgtggcgattgccgaatcagtgacgaagccaaaagttatcttgacaaggttaagactaaaaaagcggaccatgacattgtgaaagatcgccgctttaccgtggataaaatgatgttccacgtcccgattgcgatgaactttaaggcgatcagtaaaccgaacttaaacaaaaaagtcattgatggcatcattgatgatcaggatctgaaaatcattggtattgatcgtggcgagcggaacttaatttacgtcacgatggttgacagaaaagggaatatcttatatcaggattctcttaacatcctcaatggctacgactatcgtaaagctctggatgtgcgcgaatatgacaacaaggaagcgcgtcgtaactggactaaagtggagggcattcgcaaaatgaaggaaggctatctgtcattagcggtctcgaaattagcggatatgattatcgaaaataacgccatcatcgttatggaggacctgaaccacggattcaaagcgggccgctcaaagattgaaaaacaagtttatcagaaatttgagagtatgctgattaacaaactgggctatatggtgttaaaagacaagtcaattgaccaatcaggtggcgcgctgcatggataccagctggcgaaccatgttaccaccttagcatcagttggaaagcagtgtggggttatcttttatataccggcagcgttcactagtaaaatagatccgaccactggtttcgccgatctctttgccctgagtaacgttaaaaacgtagcgagcatgcgtgaattcttttccaaaatgaaatctgtcatttatgataaagctgaaggcaaattcgcattcacctttgattacttggattacaacgtgaagagcgaatgtggtcgtacgctgtggaccgtttacaccgttggtgagcgcttcacctattcccgtgtgaaccgcgaatatgtacgtaaagtccccaccgatattatctatgatgccctccagaaagcaggcattagcgtcgaaggagacttaagggacagaattgccgaaagcgatggcgatacgctgaagtctattttttacgcattcaaatacgcgctagatatgcgcgttgagaatcgcgaggaagactacattcaatcacctgtgaaaaatgcctctggggaatttttttgttcaaaaaatgctggtaaaagcctcccacaagatagcgatgcaaacggtgcatataacattgccctgaaaggtattcttcaattacgcatgctgtctgagcagtacgaccccaacgcggaatctattagacttccgctgataaccaataaagcctggctgacattcatgcagtctggcatgaagacctggaaaaattag

SEQ ID NO: 46 - DNA, 3783 bp, Artificial Sequence
  Description of Artificial Sequence: Synthetic polynucleotide
atggatagtttaaaagattttacgaatctatatcccgtaagcaaaactcttcgttttgaactgaaacctgttggaaaaacgttggagaatatcgagaaagcgggcatcctgaaagaagacgagcaccgtgccgaaagctacaggcgtgtcaaaaagattatcgatacttatcacaaagtgttcattgatagcagtctggagaacatggcaaaaatgggcatagaaaatgaaatcaaagcaatgctgcagagcttttgcgagctctacaagaaagatcaccgaacggaaggtgaagataaagcactggacaaaattcgcgccgttcttcgcggtctgattgttggcgcgttcaccggcgtgtgcggccgccgtgaaaacaccgtgcagaacgaaaagtacgagtcgctgttcaaagaaaaactgataaaagaaattttgcctgactttgtgctttcgaccgaagcggaatccctgccattttctgtcgaagaagcgacccgcagcctgaaagaatttgactcattcacaagttactttgcaggcttctacgaaaaccgtaaaaacatctacagcacgaagccacagagcacggctattgcttatcgcctgattcatgagaacctgccgaagttcatcgataacatccttgtttttcaaaaaattaaagagccgattgcgaaagagttagaacatattcgagctgacttttctgcgggtgggtacattaaaaaagatgagcggctggaagacatcttcagtctaaactattatatccacgttctgtcgcaggcaggcattgagaaatataatgcgctgattggtaagattgtcacagaaggcgatggtgagatgaaaggtcttaatgaacatatcaatctgtataaccagcagcgtggtcgcgaagaccgtcttccactgttccgcccactgtataaacagatcctgtctgaccgggaacagctgtcctacctgccggaaagctttgaaaaggatgaagagctacttcgcgcattaaaggagttttacgaccatattgcggaagacattttgggtagaacgcagcaactgatgacgtcaatttctgaatacgatctgagtagaatctacgttaggaatgatagccagctgaccgatattagcaaaaaaatgctgggcgactggaacgctatctatatggcacgtgaacgtgcatatgatcatgaacaagcaccgaaacgtataaccgcgaaatatgagcgtgatcgcattaaggcgctaaagggagaagaaagcatctcactcgcaaacctgaactcctgtatcgctttcttagataacgtgcgcgattgtcgcgtcgacacgtatctgtcaacccttgggcagaaagagggtccacatggtctgtctaacctggtggaaaatgtctttgcgagttaccatgaagcggaacaactgctgtcttttccataccccgaagaaaacaatctaatacaggataaagataacgtggtgttaatcaaaaacctgctggacaacatcagcgatctgcaacgtttcctgaaacctttgtggggtatgggtgacgagccagacaaagacgaacgtttttatggtgagtataattatatacgtggcgcccttgaccaagttattccgctgtataacaaagtacggaactatctgacccgtaagccatattctacccgtaaagtgaaactgaactttggcaactcgcaactgctgtcgggttgggatcgtaacaaagaaaaagataatagttgtgttatcctgcgtaagggacaaaatttttacctcgcgattatgaacaacagacacaagcgttcatttgaaaataaggttctgccggagtataaagagggcgaaccgtacttcgagaaaatggattataagttcttaccagaccctaataagatgttaccgaaagtctttctttcgaaaaaaggcatagaaatctataagccgtccccgaaattactcgaacagtatgggcacgggacccacaagaaaggggatacttttagcatggacgatctgcacgaactgatcgatttttttaaacactccatcgaagcccatgaagactggaaacagtttgggttcaagttctctgatacagccacatacgagaatgtgtctagtttttatcgggaagtggaggatcagggctacaaacttagttttcgtaaagtttcagagagttatgtttatagtttaattgatcagggaaaactttacctgttccagatctacaacaaagatttctcgccatgtagtaagggtaccccgaatctgcatacactctattggagaatgttattcgatgagcgtaacttagcggatgtcatttataaattggacgggaaagcagagatcttttttcgtgaaaaatcactgaagaatgaccacccgactcatccggccgggaaaccgatcaaaaaaaaatcccgccagaaaaaaggagaagagtctctgtttgaatatgatctggtgaaagaccgtcattacactatggataaatttcaatttcatgttccaattacaatgaacttcaaatgttcggcgggttccaaagtaaatgatatggtaaacgcccatattcgcgaagcgaaagatatgcatgttattggcatcgatagaggcgaaagaaacctgctttatatttgcgtaattgacagccgtggtaccattctggaccagatctctttaaacaccatcaatgacatcgattatcacgacctgttggagtctcgggacaaggaccgccagcaggagcgccgtaattggcagacaattgaaggcataaaagaattaaaacagggttacctttcccaggccgtacaccgcatagcggaactgatggtggcctacaaagccgtagttgccctggaagacttgaatatggggtttaaacgtggccgtcaaaaagtcgagagcagcgtgtatcagcaatttgaaaaacagttgattgacaagttgaattatttggttgataaaaagaaacgtccagaagatattggtggcttactgcgtgcataccagtttacggcaccttttaagtccttcaaagaaatgggtaaacagaacgggtttctgttttacatcccggcctggaatacatccaacatcgatcctaccaccgggtttgtcaacctgtttcatgcacaatatgaaaacgtggataaagcgaagagttttttccaaaaattcgatagtatttcgtataacccaaaaaaagattggtttgagtttgcgttcgattataaaaattttactaaaaaggctgagggatcccgcagtatgtggatcctctgcacccatggcagtcgtattaaaaattttcgtaattcgcaaaagaatggccagtgggactcggaagagtttgccctgaccgaagcgttcaaatcgctgtttgtacgctacgaaattgactacacagcagatctgaaaacagccatcgtcgatgaaaaacagaaagatttttttgtagatctcctaaaactgttcaaactgactgttcagatgcgcaattcctggaaagagaaagacctggattatctgattagcccggtagccggtgctgatggacgatttttcgatactcgtgaaggtaacaaaagtctcccgaaagatgctgatgccaatggtgcatacaatattgcattaaaggggctatgggccttgcgacagatccgccagaccagcgaaggcggcaagctgaaattggccatatcgaataaggaatggttacaatttgttcaggaacgtagctatgaaaaagattga

SEQ ID NO: 47 - DNA, 3792 bp, Artificial Sequence
  Description of Artificial Sequence: Synthetic polynucleotide
atgaacaacggcacaaataattttcagaacttcatcgggatctcaagtttgcagaaaacgctgcgcaatgctctgatccccacggaaaccacgcaacagttcatcgtcaagaacggaataattaaagaagatgagttacgtggcgagaaccgccagattctgaaagatatcatggatgactactaccgcggattcatctctgagactctgagttctattgatgacatagattggactagcctgttcgaaaaaatggaaattcagctgaaaaatggtgataataaagataccttaattaaggaacagacagagtatcggaaagcaatccataaaaaatttgcgaacgacgatcggtttaagaacatgtttagcgccaaactgattagtgacatattacctgaatttgtcatccacaacaataattattcggcatcagagaaagaggaaaaaacccaggtgataaaattgttttcgcgctttgcgactagctttaaagattacttcaagaaccgtgcaaattgcttttcagcggacgatatttcatcaagcagctgccatcgcatcgtcaacgacaatgcagagatattcttttcaaatgcgctggtctaccgccggatcgtaaaatcgctgagcaatgacgatatcaacaaaatttcgggcgatatgaaagattcattaaaagaaatgagtctggaagaaatatattcttacgagaagtatggggaatttattacccaggaaggcattagcttctataatgatatctgtgggaaagtgaattcttttatgaacctgtattgtcagaaaaataaagaaaacaaaaatttatacaaacttcagaaacttcacaaacagattctatgcattgcggacactagctatgaggtcccgtataaatttgaaagtgacgaggaagtgtaccaatcagttaacggcttccttgataacattagcagcaaacatatagtcgaaagattacgcaaaatcggcgataactataacggctacaacctggataaaatttatatcgtgtccaaattttacgagagcgttagccaaaaaacctaccgcgactgggaaacaattaataccgccctcgaaattcattacaataatatcttgccgggtaacggtaaaagtaaagccgacaaagtaaaaaaagcggttaagaatgatttacagaaatccatcaccgaaataaatgaactagtgtcaaactataagctgtgcagtgacgacaacatcaaagcggagacttatatacatgagattagccatatcttgaataactttgaagcacaggaattgaaatacaatccggaaattcacctagttgaatccgagctcaaagcgagtgagcttaaaaacgtgctggacgtgatcatgaatgcgtttcattggtgttcggtttttatgactgaggaacttgttgataaagacaacaatttttatgcggaactggaggagatttacgatgaaatttatccagtaattagtctgtacaacctggttcgtaactacgttacccagaaaccgtacagcacgaaaaagattaaattgaactttggaataccgacgttagcagacggttggtcaaagtccaaagagtattctaataacgctatcatactgatgcgcgacaatctgtattatctgggcatctttaatgcgaagaataaaccggacaagaagattatcgagggtaatacgtcagaaaataagggtgactacaaaaagatgatttataatttgctcccgggtcccaacaaaatgatcccgaaagttttcttgagcagcaagacgggggtggaaacgtataaaccgagcgcctatatcctagaggggtataaacagaataaacatatcaagtcttcaaaagactttgatatcactttctgtcatgatctgatcgactacttcaaaaactgtattgcaattcatcccgagtggaaaaacttcggttttgattttagcgacaccagtacttatgaagacatttccgggttttatcgtgaggtagagttacaaggttacaagattgattggacatacattagcgaaaaagacattgatctgctgcaggaaaaaggtcaactgtatctgttccagatatataacaaagatttttcgaaaaaatcaaccgggaatgacaaccttcacaccatgtacctgaaaaatcttttctcagaagaaaatcttaaggatatcgtcctgaaacttaacggcgaagcggaaatcttcttcaggaagagcagcataaagaacccaatcattcataaaaaaggctcgattttagtcaaccgtacctacgaagcagaagaaaaagaccagtttggcaacattcaaattgtgcgtaaaaatattccggaaaacatttatcaggagctgtacaaatacttcaacgataaaagcgacaaagagctgtctgatgaagcagccaaactgaagaatgtagtgggacaccacgaggcagcgacgaatatagtcaaggactatcgctacacgtatgataaatacttccttcatatgcctattacgatcaatttcaaagccaataaaacgggttttattaatgataggatcttacagtatatcgctaaagaaaaagacttacatgtgatcggcattgatcggggcgagcgtaacctgatctacgtgtccgtgattgatacttgtggtaatatagttgaacagaaaagctttaacattgtaaacggctacgactatcagataaaactgaaacaacaggagggcgctagacagattgcgcggaaagaatggaaagaaattggtaaaattaaagagatcaaagagggctacctgagcttagtaatccacgagatctctaaaatggtaatcaaatacaatgcaattatagcgatggaggatttgtcttatggttttaaaaaagggcgctttaaggtcgaacggcaagtttaccagaaatttgaaaccatgctcatcaataaactcaactatctggtatttaaagatatttcgattaccgagaatggcggtctcctgaaaggttatcagctgacatacattcctgataaacttaaaaacgtgggtcatcagtgcggctgcattttttatgtgcctgctgcatacacgagcaaaattgatccgaccaccggctttgtgaatatctttaaatttaaagacctgacagtggacgcaaaacgtgaattcattaaaaaatttgactcaattcgttatgacagtgaaaaaaatctgttctgctttacatttgactacaataactttattacgcaaaacacggtcatgagcaaatcatcgtggagtgtgtatacatacggcgtgcgcatcaaacgtcgctttgtgaacggccgcttctcaaacgaaagtgataccattgacataaccaaagatatggagaaaacgttggaaatgacggacattaactggcgcgatggccacgatcttcgtcaagacattatagattatgaaattgttcagcacatattcgaaattttccgtttaacagtgcaaatgcgtaactccttgtctgaactggaggaccgtgattacgatcgtctcatttcacctgtactgaacgaaaataacattttttatgacagcgcgaaagcgggggatgcacttcctaaggatgccgatgcaaatggtgcgtattgtattgcattaaaagggttatatgaaattaaacaaattaccgaaaattggaaagaagatggtaaattttcgcgcgataaactcaaaatcagcaataaagattggttcgactttatccagaataagcgctatctctaa

SEQ ID NO: 48 - DNA, 3957 bp, Artificial Sequence
  Description of Artificial Sequence: Synthetic polynucleotide
atgaccaataaattcactaaccagtattctctctctaagaccctgcgctttgaactgattccgcaggggaaaaccttggagttcattcaagaaaaaggcctcttgtctcaggataaacagagggctgaatcttaccaagaaatgaagaaaactattgataagtttcataaatatttcattgatttagccttgtctaacgccaaattaactcacttggaaacgtatctggagttatacaacaaatctgccgaaactaagaaagaacagaaatttaaagacgatttgaaaaaagtacaggacaatctgcgtaaagaaattgtcaaatccttcagtgacggcgatgctaaaagcatttttgccattctggacaaaaaagagttgattactgtggaattagaaaagtggtttgaaaacaatgagcagaaagacatctacttcgatgagaaattcaaaactttcaccacctattttacaggatttcatcaaaaccggaagaacatgtactcagtagaaccgaactccacggccattgcgtatcgtttgatccatgagaatctgcctaaatttctggagaatgcgaaagcctttgaaaagattaagcaggtcgaatcgctgcaagtgaattttcgtgaactcatgggcgaatttggtgacgaaggtctaatcttcgttaacgaactggaagaaatgtttcagattaattactacaatgacgtgctatcgcagaacggtatcacaatctacaatagtattatctcagggttcacaaaaaacgatataaaatacaaaggcctgaacgagtatatcaataactacaaccaaacaaaggacaaaaaggataggcttccgaaactgaagcagttatacaaacagattttatctgacagaatctccctgagctttctgccggatgctttcactgatgggaagcaggttctgaaagcgattttcgatttttataagattaacttactgagctacacgattgaaggtcaagaagaatctcaaaacttactgctcttgatccgtcaaaccattgaaaatctatcatcgttcgatacgcagaaaatctacctcaaaaacgatactcacctgactacgatctctcagcaggttttcggggattttagtgtattttcaacagctctgaactactggtatgaaaccaaagtcaatccgaaattcgagacggaatattctaaggccaacgaaaaaaaacgtgagattcttgataaagctaaagccgtatttactaaacaggattacttttctattgctttcctgcaggaagttttatcggagtatatcctgaccctggatcatacatctgatatcgttaaaaaacacagcagcaattgcatcgctgactatttcaaaaaccactttgtcgccaaaaaagaaaacgaaacagacaagactttcgatttcattgctaacatcaccgcaaaataccagtgtattcagggtatcttggaaaacgccgaccaatacgaagacgaactgaaacaagatcagaagctgatcgataatttaaaattcttcttagatgcaatcctggagctgctgcacttcatcaaaccgcttcatttaaagagcgagtccattaccgaaaaggacaccgccttctatgacgtttttgaaaattattatgaagccctctccttgctgactccgctgtataatatggtacgcaattacgtaacccagaaaccatattctaccgaaaaaattaaactgaactttgaaaacgcacagctgctcaacggttgggacgcgaataaagaaggtgactacctcaccaccatcctgaaaaaagatggtaactattttctggcaattatggataagaaacataataaagcattccagaaatttcctgaagggaaagaaaattacgaaaagatggtgtacaaactcttacctggagttaacaaaatgttgccgaaagtattttttagtaataagaacatcgcgtactttaacccgtccaaagaactgctggaaaattataaaaaggagacgcataagaaaggggatacctttaacctggaacattgccataccttaatagacttcttcaaggattccctgaataaacacgaggattggaaatatttcgattttcagtttagtgagaccaagtcataccaggatcttagcggcttttatcgcgaagtagaacaccaaggctataaaattaacttcaaaaacatcgacagcgaatacatcgacggtttagttaacgagggcaaactgtttctgttccagatctattcaaaggattttagcccgttctctaaaggcaaaccaaatatgcatacgttgtactggaaagcactgtttgaagagcaaaacctgcagaatgtgatttataaactgaacggccaagctgagatttttttccgtaaagcctcgattaaaccgaaaaatatcatccttcataagaagaaaataaagatcgctaaaaaacacttcatagataaaaaaaccaaaacctccgaaatagtgcctgttcaaacaattaagaacttgaatatgtactaccagggcaagatatcggaaaaggagttgactcaagacgatcttcgctatatcgataacttttcgatttttaacgaaaaaaacaagacgatcgacatcatcaaagataaacgcttcactgtagataagttccagtttcatgtgccgattactatgaacttcaaagctaccgggggtagctatatcaaccaaacggtgttggaatacctgcagaataacccggaagtcaaaatcattgggctggaccgcggagaacgtcaccttgtgtacttgaccttaatcgatcagcaaggcaacatcttaaaacaagaatcgctgaataccattacggattcaaagattagcaccccgtatcataagctgctcgataacaaggagaatgagcgcgacctggcccgtaaaaactggggcacggtggaaaacattaaggagttaaaggagggttatatttcccaggtagtgcataagatcgccactctcatgctcgaggaaaatgcgatcgttgtcatggaagacttaaacttcggatttaaacgtgggcgatttaaagtagagaaacaaatctaccagaagttagaaaaaatgctgattgacaaattaaattacttggtcctaaaagacaaacagccgcaagaattgggtggattatacaacgccctccaacttaccaataaattcgaaagttttcagaaaatgggtaaacagtcaggctttcttttttatgttcctgcgtggaacacatccaaaatcgaccctacaaccggcttcgtcaattacttctatactaaatatgaaaacgtcgacaaagcaaaagcattctttgaaaagttcgaagcaatacgttttaacgctgagaaaaaatatttcgagttcgaagtcaagaaatactcagactttaaccccaaagctgagggcacacagcaagcgtggacaatctgcacctacggcgagcgcatcgaaacgaagcgtcaaaaagatcagaataacaaatttgtttcaacacctatcaacctgaccgagaagattgaagacttcttaggtaaaaatcagattgtttatggcgacggtaactgtataaaatctcaaatagcctcaaaggatgataaagcatttttcgaaacattattatattggttcaaaatgacactgcagatgcgcaatagtgagacgcgtacagatattgattatcttatcagcccggtcatgaacgacaacggtactttttacaactccagagactatgaaaaacttgagaatccaactctccccaaagatgctgatgcgaacggtgcttatcacatcgcgaaaaaaggtctgatgctgctgaacaaaatcgaccaagccgatctgactaagaaagttgacctaagcatttcaaatcgggactggttacagtttgttcaaaagaacaaatga

SEQ ID NO: 49 - DNA, 4023 bp, Artificial Sequence
  Description of Artificial Sequence: Synthetic polynucleotide
atggaacaggaatattatctgggcttggacatgggcaccggttccgtcggctgggctgttactgacagtgaatatcacgttctaagaaagcatggtaaggcattgtggggtgtaagacttttcgaatctgcttccactgctgaagagcgtagaatgtttagaacgagtcgacgtaggctagacaggcgcaattggagaatcgaaattttacaagaaatttttgcggaagagatatctaagaaagacccaggctttttcctgagaatgaaggaatctaagtattaccctgaggataaaagagatataaatggtaactgtcccgaattgccttacgcattatttgtggacgatgattttaccgataaggattaccataaaaagttcccaactatctaccatttacgcaaaatgttaatgaatacagaggaaaccccagacataagactagtttatctggcaatacaccatatgatgaaacatagaggccatttcttactttccggggatatcaacgaaatcaaagagtttggtaccacatttagtaagttactggaaaacataaagaatgaagaattggattggaacttagaactcggaaaagaagaatacgcggttgtcgaatctatcctgaaggataatatgctgaataggtcgaccaaaaaaactaggctgatcaaagcactgaaagccaaatctatctgcgaaaaagctgttttaaatttacttgctggtggcactgttaagttatcagacatttttggtttggaagaattgaacgaaaccgagcgtccaaaaattagtttcgctgataatggctacgatgattacattggtgaggtggaaaacgagttgggcgaacaattttatattatagagacagctaaggcagtctatgactgggctgttttagtagaaatccttggtaaatacacatctatctccgaagcgaaagttgctacttacgaaaagcacaagtccgatctccagtttttgaagaaaattgtcaggaaatatctgactaaggaagaatataaagatattttcgttagtacctctgacaaactgaaaaattactccgcttacatcgggatgaccaagattaatggcaaaaaagttgatctgcaaagcaaaaggtgttcgaaggaagaattttatgatttcattaaaaagaatgtcttaaaaaaattagaaggtcagccagaatacgaatatttgaaagaagaactggaaagagagacattcttaccaaaacaagtcaacagagataatggggtaattccatatcaaattcacctctacgaattaaaaaaaattttaggcaatttacgcgataaaattgaccttatcaaagaaaatgaggataagctggttcaactctttgaattcagaataccctattatgtgggcccactgaacaagattgatgacggcaaagaaggtaaattcacatgggccgtccgcaaatccaatgaaaaaatttacccatggaactttgaaaatgtagtagatattgaagcgtctgcggagaaatttattcgaagaatgactaataaatgcacttacttgatgggagaggatgttctgcctaaagacagcttattatacagcaagtacatggttctaaacgaacttaacaacgttaagttggacggtgagaaattaagtgtagaattgaaacaaagattgtatactgacgtcttctgcaagtacagaaaagtgacagttaaaaaaattaagaattacttgaagtgcgaaggtataatttctggaaacgtagagattactggtattgatggtgatttcaaagcatccctaacagcttaccacgatttcaaggaaatcctgacaggaactgaactcgcaaaaaaagataaagaaaacattattactaatattgttcttttcggtgatgacaagaaattgttgaagaaaagactgaatagactttacccccagattactcccaatcaacttaagaaaatttgtgctttgtcttacacaggatggggtcgtttttcaaaaaagttcttagaagagattaccgcacctgatccagaaacaggcgaagtatggaatataattaccgccttatgggaatcgaacaataatcttatgcaacttctgagcaatgaatatcgtttcatggaagaagttgagacttacaacatgggcaaacagacgaagactttatcctatgaaactgtggaaaatatgtatgtatcaccttctgtcaagagacaaatttggcaaaccttaaaaattgtcaaagaattagaaaaggtaatgaaggagtctcctaaacgtgtgtttattgaaatggctagagaaaaacaagagtcaaaaagaaccgagtcaagaaagaagcagttaatcgatttatataaggcttgtaaaaacgaagagaaagattgggttaaagaattgggggaccaagaggaacaaaaactacggtcggataagttgtatttatactatacgcaaaagggacgatgtatgtattccggcgaggtaatagaattgaaggatttatgggacaatacaaaatatgacatagaccatatatatccccaatcaaaaacgatggacgatagcttgaacaatagagtactcgtgaaaaaaaaatataatgcgaccaaatctgataagtatcctctgaatgaaaatatcagacatgaaagaaaggggttctggaagtccttgttagatggtgggtttataagcaaagaaaagtacgagcgtctaataagaaacacggagttatcgccagaagaactcgctggttttattgagaggcaaatcgtggaaacgagacaatctaccaaagccgttgctgagatcctaaagcaagttttcccagagtcggagattgtctatgtcaaagctggcacagtgagcaggtttaggaaagacttcgaactattaaaggtaagagaagtgaacgatttacatcacgcaaaggacgcttacctaaatatcgttgtaggtaactcatattatgttaaatttaccaagaacgcctcttggtttataaaggagaacccaggtagaacatataacctgaaaaagatgttcacctctggttggaatattgagagaaacggagaagtcgcatgggaagttggtaagaaagggactatagtgacagtaaagcaaattatgaacaaaaataatatcctcgttacaaggcaggttcatgaagcaaagggcggcctttttgaccaacaaattatgaagaaagggaaaggtcaaattgcaataaaagaaaccgatgagagactagcgtcaatagaaaagtatggtggctataataaagctgcgggtgcatactttatgcttgttgaatcaaaagacaagaaaggtaagactattagaactatagaatttatacccctgtaccttaaaaacaaaattgaatcggatgagtcaatcgcgttaaattttctagagaaaggaaggggtttaaaagaaccaaagatcctgttaaaaaagattaagattgacaccttgttcgatgtagatggatttaaaatgtggttatctggcagaacaggcgatagacttttgtttaagtgcgctaatcaattaattttggatgagaaaatcattgtcacaatgaaaaaaatagttaagtttattcagagaagacaagaaaacagggagttgaaattatctgataaagatggtatcgacaatgaagttttaatggaaatctacaatacattcgttgataaacttgaaaataccgtatatcgaatcaggttaagtgaacaagccaaaacattaattgataaacaaaaagaatttgaaaggctatcactggaagacaaatcctccaccctatttgaaattttgcatatattccagtgccaatcttcagcagctaatttaaaaatgattggcggacctgggaaagccggcatcctagtgatgaacaataatatctccaagtgtaacaaaatatcaattattaaccaatctccgacaggtatttttgaaaatgaaatagacttgcttaagatataa

SEQ ID NO: 50 - DNA, 3831 bp, Artificial Sequence
  Description of Artificial Sequence: Synthetic polynucleotide
atgtctttcgactctttcaccaacctgtactctctgtctaaaaccctgaaattcgaaatgcgtccggttggtaacacccagaaaatgctggacaacgcgggtgttttcgaaaaagacaaactgatccagaaaaaatacggtaaaaccaaaccgtacttcgaccgtctgcaccgtgaattcatcgaagaagcgctgaccggtgttgaactgatcggtctggacgaaaacttccgtaccctggttgactggcagaaagacaaaaaaaacaacgttgcgatgaaagcgtacgaaaactctctgcagcgtctgcgtaccgaaatcggtaaaatcttcaacctgaaagcggaagactgggttaaaaacaaatacccgatcctgggtctgaaaaacaaaaacaccgacatcctgttcgaagaagcggttttcggtatcctgaaagcgcgttacggtgaagaaaaagacaccttcatcgaagttgaagaaatcgacaaaaccggtaaatctaaaatcaaccagatctctatcttcgactcttggaaaggtttcaccggttacttcaaaaaattcttcgaaacccgtaaaaacttctacaaaaacgacggtacctctaccgcgatcgcgacccgtatcatcgaccagaacctgaaacgtttcatcgacaacctgtctatcgttgaatctgttcgtcagaaagttgacctggcggaaaccgaaaaatctttctctatctctctgtctcagttcttctctatcgacttctacaacaaatgcctgctgcaggacggtatcgactactacaacaaaatcatcggtggtgaaaccctgaaaaacggtgaaaaactgatcggtctgaacgaactgatcaaccagtaccgtcagaacaacaaagaccagaaaatcccgttcttcaaactgctggacaaacagatcctgtctgaaaaaatcctgttcctggacgaaatcaaaaacgacaccgaactgatcgaagcgctgtctcagttcgcgaaaaccgcggaagaaaaaaccaaaatcgttaaaaaactgttcgcggacttcgttgaaaacaactctaaatacgacctggcgcagatctacatctctcaggaagcgttcaacaccatctctaacaaatggacctctgaaaccgaaaccttcgcgaaatacctgttcgaagcgatgaaatctggtaaactggcgaaatacgaaaaaaaagacaactcttacaaattcccggacttcatcgcgctgtctcagatgaaatctgcgctgctgtctatctctctggaaggtcacttctggaaagaaaaatactacaaaatctctaaattccaggaaaaaaccaactgggaacagttcctggcgatcttcctgtacgaattcaactctctgttctctgacaaaatcaacaccaaagacggtgaaaccaaacaggttggttactacctgttcgcgaaagacctgcacaacctgatcctgtctgaacagatcgacatcccgaaagactctaaagttaccatcaaagacttcgcggactctgttctgaccatctaccagatggcgaaatacttcgcggttgaaaaaaaacgtgcgtggctggcggaatacgaactggactctttctacacccagccggacaccggttacctgcagttctacgacaacgcgtacgaagacatcgttcaggtttacaacaaactgcgtaactacctgaccaaaaaaccgtactctgaagaaaaatggaaactgaacttcgaaaactctaccctggcgaacggttgggacaaaaacaaagaatctgacaactctgcggttatcctgcagaaaggtggtaaatactacctgggtctgatcaccaaaggtcacaacaaaatcttcgacgaccgtttccaggaaaaattcatcgttggtatcgaaggtggtaaatacgaaaaaatcgtttacaaattcttcccggaccaggcgaaaatgttcccgaaagtttgcttctctgcgaaaggtctggaattcttccgtccgtctgaagaaatcctgcgtatctacaacaacgcggaattcaaaaaaggtgaaacctactctatcgactctatgcagaaactgatcgacttctacaaagactgcctgaccaaatacgaaggttgggcgtgctacaccttccgtcacctgaaaccgaccgaagaataccagaacaacatcggtgaattcttccgtgacgttgcggaagacggttaccgtatcgacttccagggtatctctgaccagtacatccacgaaaaaaacgaaaaaggtgaactgcacctgttcgaaatccacaacaaagactggaacctggacaaagcgcgtgacggtaaatctaaaaccacccagaaaaacctgcacaccctgtacttcgaatctctgttctctaacgacaacgttgttcagaacttcccgatcaaactgaacggtcaggcggaaatcttctaccgtccgaaaaccgaaaaagacaaactggaatctaaaaaagacaaaaaaggtaacaaagttatcgaccacaaacgttactctgaaaacaaaatcttcttccacgttccgctgaccctgaaccgtaccaaaaacgactcttaccgtttcaacgcgcagatcaacaacttcctggcgaacaacaaagacatcaacatcatcggtgttgaccgtggtgaaaaacacctggtttactactctgttatcacccaggcgtctgacatcctggaatctggttctctgaacgaactgaacggtgttaactacgcggaaaaactgggtaaaaaagcggaaaaccgtgaacaggcgcgtcgtgactggcaggacgttcagggtatcaaagacctgaaaaaaggttacatctctcaggttgttcgtaaactggcggacctggcgatcaaacacaacgcgatcatcatcctggaagacctgaacatgcgtttcaaacaggttcgtggtggtatcgaaaaatctatctaccagcagctggaaaaagcgctgatcgacaaactgtctttcctggttgacaaaggtgaaaaaaacccggaacaggcgggtcacctgctgaaagcgtaccagctgtctgcgccgttcgaaaccttccagaaaatgggtaaacagaccggtatcatcttctacacccaggcgtcttacacctctaaatctgacccggttaccggttggcgtccgcacctgtacctgaaatacttctctgcgaaaaaagcgaaagacgacatcgcgaaattcaccaaaatcgaattcgttaacgaccgtttcgaactgacctacgacatcaaagacttccagcaggcgaaagaatacccgaacaaaaccgtttggaaagtttgctctaacgttgaacgtttccgttgggacaaaaacctgaaccagaacaaaggtggttacacccactacaccaacatcaccgaaaacatccaggaactgttcaccaaatacggtatcgacatcaccaaagacctgctgacccagatctctaccatcgacgaaaaacagaacacctctttcttccgtgacttcatcttctacttcaacctgatctgccagatccgtaacaccgacgactctgaaatcgcgaaaaaaaacggtaaagacgacttcatcctgtctccggttgaaccgttcttcgactctcgtaaagacaacggtaacaaactgccggaaaacggtgacgacaacggtgcgtacaacatcgcgcgtaaaggtatcgttatcctgaacaaaatctctcagtactctgaaaaaaacgaaaactgcgaaaaaatgaaatggggtgacctgtacgtttctaacatcgactgggacaacttcgtt

SEQ ID NO: 51 - DNA, 3465 bp, Artificial Sequence
  Description of Artificial Sequence: Synthetic polynucleotide
atggaaaactttaaaaacttatacccaataaacaaaacgttacgttttgaactgcgtccatatggtaaaacactggaaaactttaaaaaaagcggtttgttggagaaggatgcatttaaagcgaactctcgcagatccatgcaggccatcattgatgaaaaatttaaagagacgatcgaagaacgtctgaaatacacggaatttagtgagtgtgacttaggtaatatgacttctaaagataagaaaatcaccgataaggcggcgaccaacctgaagaagcaagtcattttatcttttgatgatgaaatctttaacaactatttgaaaccggacaaaaacatcgatgccttatttaaaaatgacccttcgaacccggtgattagcacatttaagggcttcacaacgtattttgtcaatttttttgaaattcgtaaacatatcttcaaaggagaatcaagcggctctatggcttatcgcattattgatgaaaacctgacgacctatttgaataacattgaaaaaatcaaaaaactgccagaggaattaaagtctcagttagaaggcatcgaccagatcgacaaactcaacaactataacgaatttattacgcagtctggtatcacccactataatgaaattattggaggtatcagtaaatcagaaaatgtgaaaatccaagggattaatgaaggcattaacctctattgccagaaaaataaagtgaaactgccgaggctgactccactctacaaaatgatcctgtctgaccgcgtctcgaatagctttgtcctggacacaattgaaaacgatacggaattgattgagatgataagcgatctgattaacaaaaccgaaatttcacaggatgtaatcatgagtgatatacaaaacatctttattaaatataaacagcttggtaatctgcctggaattagctattcgtcaatagtgaacgcaatctgttctgattatgataacaattttggcgacggtaagcgtaaaaagagttatgaaaacgataggaaaaaacacctggaaactaacgtgtattctatcaactatatcagcgaactgcttacggacaccgatgtgagttcaaacattaagatgcggtataaggagcttgaacagaactaccaggtctgtaaggaaaacttcaacgcaaccaactggatgaacattaaaaatatcaaacaatccgagaagaccaacttaatcaaagatctgctggatattttgaagagcattcaacgtttttatgatctgttcgatatcgttgatgaagacaagaatcctagtgcggaattttatacatggctgtctaaaaatgcggagaaattggatttcgaattcaattctgtttataataaatcacgcaactatttgacccgcaaacaatacagcgacaaaaagataaaactaaacttcgacagtccgacattggcaaagggctgggacgcaaataaggaaatcgataactctacgataattatgcgtaagttcaataatgatcgaggtgattatgattatttcttaggcatttggaacaaaagcaccccggccaacgaaaagataattccactggaggataacggtctgttcgaaaaaatgcagtacaaattatatccggatccaagcaagatgcttccaaagcagtttctgtctaaaatttggaaagctaagcatccgaccaccccagaatttgacaagaaatataaggaaggccgccataagaaaggtcccgattttgaaaaagaattcttgcacgaactgattgattgctttaaacatggcttagtcaatcacgatgaaaagtatcaagatgtttttggattcaatttgagaaacacagaagactacaattcctacactgagtttctcgaagatgtggaacgatgtaattataatctgagctttaacaaaatcgcggacacctcgaatctgattaacgatggtaaactttatgttttccagatctggagcaaggatttctctattgacagcaaaggcaccaaaaacctgaacaccatttactttgaaagtctcttcagcgaagaaaatatgattgagaaaatgtttaaacttagcggtgaagctgaaatattctatcgcccggcaagcctgaactattgcgaagacattatcaaaaagggtcatcaccacgctgaactgaaagataaatttgattatcctatcataaaagataaacgctatagccaggataaatttttttttcatgttcctatggtcattaactacaaatcagaaaaactgaactctaaaagcctcaataatcgaaccaatgaaaaccttgggcagtttacccatataattggaattgatcgcggagagcgtcatttaatctacctgaccgtagtcgatgtatcgaccggcgagatcgtcgagcagaagcacttagacgagattatcaacactgataccaaaggtgttgagcataagacgcactatctaaacaagctggaggaaaaatcgaaaacccgtgataatgaacgtaagagttgggaggcaattgaaacgattaaagaactgaaggagggttatatcagccacgtaatcaatgaaattcaaaaactgcaggaaaaatacaacgccctgatcgttatggaaaatctgaattacggtttcaaaaattctcgcatcaaagtggaaaaacaggtatatcagaagttcgagacggcattaattaaaaagtttaattacatcattgacaaaaaagatccggaaacttatattcatggctatcagctgacgaacccgatcaccacactggataaaattggtaaccagtctggtatcgtgctttacatccctgcctggaataccagtaaaatcgatccggtaacgggattcgtcaaccttctatatgcagatgacctcaaatataagaatcaggaacaggccaagtcttttattcagaaaatcgataacatttactttgagaatggggaattcaaatttgatattgatttttctaaatggaacaatcgttatagtatatctaagacgaaatggacgctcacctcgtacggaacccgaatccagacattccgcaatccgcagaagaacaataaatgggacagcgccgagtatgatctcactgaagaattcaaattgattctgaacattgacggtaccctgaaaagccaggatgtcgaaacctataaaaaatttatgtctctgttcaagctgatgctgcaacttaggaactctgttaccggcactgatatcgattatatgatctcccctgtcactgataaaacaggtacgcatttcgattcgcgcgaaaatatcaaaaatctgcccgcagatgccgacgccaatggggcgtacaatattgcacgcaagggtatcatggcgatcgaaaacattatgaatggtatcagcgacccgctgaaaatctcaaacgaagattatttgaaatatatccaaaaccagcaggaataa

SEQ ID NO: 52 - DNA, 3923 bp, Artificial Sequence
  Description of Artificial Sequence: Synthetic polynucleotide
atgacccagttcgaaggtttcaccaacctgtaccaggtttctaaaaccctgcgtttcgaactgatcccgcagggtaaaaccctgaaacacatccaggaacagggtttcatcgaagaagacaaagcgcgtaacgaccactacaaagaactgaaaccgatcatcgaccgtatctacaaaacctacgcggaccagtgcctgcagctggttcagctggactgggaaaacctgtctgcggcgatcgactcttaccgtaaagaaaaaaccgaagaaacccgtaacgcgctgatcgaagaacaggcgacctaccgtaacgcgatccacgactacttcatcggtcgtaccgacaacctgaccgacgcgatcaacaaacgtcacgcggaaatctacaaaggtctgttcaaagcggaactgttcaacggtaaagttctgaaacagctgggtaccgttaccaccaccgaacacgaaaacgcgctgctgcgttctttcgacaaattcaccacctacttctctggtttctacgaaaaccgtaaaaacgttttctctgcggaagacatctctaccgcgatcccgcaccgtatcgttcaggacaacttcccgaaattcaaagaaaactgccacatcttcacccgtctgatcaccgcggttccgtctctgcgtgaacacttcgaaaacgttaaaaaagcgatcggtatcttcgtttctacctctatcgaagaagttttctctttcccgttctacaaccagctgctgacccagacccagatcgacctgtacaaccagctgctgggtggtatctctcgtgaagcgggtaccgaaaaaatcaaaggtctgaacgaagttctgaacctggcgatccagaaaaacgacgaaaccgcgcacatcatcgcgtctctgccgcaccgtttcatcccgctgttcaaacagatcctgtctgaccgtaacaccctgtctttcatcctggaagaattcaaatctgacgaagaagttatccagtctttctgcaaatacaaaaccctgctgcgtaacgaaaacgttctggaaaccgcggaagcgctgttcaacgaactgaactctatcgacctgacccacatcttcatctctcacaaaaaactggaaaccatctcttctgcgctgtgcgaccactgggacaccctgcgtaacgcgctgtacgaacgtcgtatctctgaactgaccggtaaaatcaccaaatctgcgaaagaaaaagttcagcgttctctgaaacacgaagacatcaacctgcaggaaatcatctctgcggcgggtaaagaactgtctgaagcgttcaaacagaaaacctctgaaatcctgtctcacgcgcacgcggcgctggaccagccgctgccgaccaccctgaaaaaacaggaagaaaaagaaatcctgaaatctcagctggactctctgctgggtctgtaccacctgctggactggttcgcggttgacgaatctaacgaagttgacccggaattctctgcgcgtctgaccggtatcaaactggaaatggaaccgtctctgtctttctacaacaaagcgcgtaactacgcgaccaaaaaaccgtactctgttgaaaaattcaaactgaacttccagatgccgaccctggcgtctggttgggacgttaacaaagaaaaaaacaacggtgcgatcctgttcgttaaaaacggtctgtactacctgggtatcatgccgaaacagaaaggtcgttacaaagcgctgtctttcgaaccgaccgaaaaaacctctgaaggtttcgacaaaatgtactacgactacttcccggacgcggcgaaaatgatcccgaaatgctctacccagctgaaagcggttaccgcgcacttccagacccacaccaccccgatcctgctgtctaacaacttcatcgaaccgctggaaatcaccaaagaaatctacgacctgaacaacccggaaaaagaaccgaaaaaattccagaccgcgtacgcgaaaaaaaccggtgaccagaaaggttaccgtgaagcgctgtgcaaatggatcgacttcacccgtgacttcctgtctaaatacaccaaaaccacctctatcgacctgtcttctctgcgtccgtcttctcagtacaaagacctgggtgaatactacgcggaactgaacccgctgctgtaccacatctctttccagcgtatcgcggaaaaagaaatcatggacgcggttgaaaccggtaaactgtacctgttccagatctacaacaaagacttcgcgaaaggtcaccacggtaaaccgaacctgcacaccctgtactggaccggtctgttctctccggaaaacctggcgaaaacctctatcaaactgaacggtcaggcggaactgttctaccgtccgaaatctcgtatgaaacgtatggcgcaccgtctgggtgaaaaaatgctgaacaaaaaactgaaagaccagaaaaccccgatcccggacaccctgtaccaggaactgtacgactacgttaaccaccgtctgtctcacgacctgtctgacgaagcgcgtgcgctgctgccgaacgttatcaccaaagaagtttctcacgaaatcatcaaagaccgtcgtttcacctctgacaaattcttcttccacgttccgatcaccctgaactaccaggcggcgaactctccgtctaaattcaaccagcgtgttaacgcgtacctgaaagaacacccggaaaccccgatcatcggtatcgaccgtggtgaacgtaacctgatctacatcaccgttatcgactctaccggtaaaatcctggaacagcgttctctgaacaccatccagcagttcgactaccagaaaaaactggacaaccgtgaaaaagaacgtgttgcggcgcgtcaggcgtggtctgttgttggtaccatcaaagacctgaaacagggttacctgtctcaggttatccacgaaatcgttgacctgatgatccactaccaggcggttgttgttctggaaaacctgaacttcggtttcaaatctaaacgtaccggtatcgcggaaaaagcggtttaccagcagttcgaaaaaatgctgatcgacaaactgaactgcctggttctgaaagactacccggcggaaaaagttggtggtgttctgaacccgtaccagctgaccgaccagttcacctctttcgcgaaaatgggtacccagtctggtttcctgttctacgttccggcgccgtacacctctaaaatcgacccgctgaccggtttcgttgacccgttcgtttggaaaaccatcaaaaaccacgaatctcgtaaacacttcctggaaggtttcgacttcctgcactacgacgttaaaaccggtgacttcatcctgcacttcaaaatgaaccgtaacctgtctttccagcgtggtctgccgggtttcatgccggcgtgggacatcgttttcgaaaaaaacgaaacccagttcgacgcgaaaggtaccccgttcatcgcgggtaaacgtatcgttccggttatcgaaaaccaccgtttcaccggtcgttaccgtgacctgtacccggcgaacgaactgatcgcgctgctggaagaaaaaggtatcgttttccgtgacggttctaacatcctgccgaaactgctggaaaacgacgactctcacgcgatcgacaccatggttgcgctgatccgttctgttctgcagatgcgtaactctaacgcggcgaccggtgaagactacatcaactctccggttcgtgacctgaacggtgtttgcttcgactctcgtttccagaacccggaatggccgatggacgcggacgcgaacggtgcgtaccacatcgcgctgaaaggtcagctgctgctgaaccacctgaaagaatctaaagacctgaaactgcagaacggtatctctaaccaggactggctggcgtacatccaggaactgcgtaacta

SEQ ID NO: 53 - DNA, 3390 bp, Artificial Sequence
  Description of Artificial Sequence: Synthetic polynucleotide
atggcggttaaatctatcaaagttaaactgcgtctggacgacatgccggaaatccgtgcgggtctgtggaaactgcacaaagaagttaacgcgggtgttcgttactacaccgaatggctgtctctgctgcgtcaggaaaacctgtaccgtcgttctccgaacggtgacggtgaacaggaatgcgacaaaaccgcggaagaatgcaaagcggaactgctggaacgtctgcgtgcgcgtcaggttgaaaacggtcaccgtggtccggcgggttctgacgacgaactgctgcagctggcgcgtcagctgtacgaactgctggttccgcaggcgatcggtgcgaaaggtgacgcgcagcagatcgcgcgtaaattcctgtctccgctggcggacaaagacgcggttggtggtctgggtatcgcgaaagcgggtaacaaaccgcgttgggttcgtatgcgtgaagcgggtgaaccgggttgggaagaagaaaaagaaaaagcggaaacccgtaaatctgcggaccgtaccgcggacgttctgcgtgcgctggcggacttcggtctgaaaccgctgatgcgtgtttacaccgactctgaaatgtcttctgttgaatggaaaccgctgcgtaaaggtcaggcggttcgtacctgggaccgtgacatgttccagcaggcgatcgaacgtatgatgtcttgggaatcttggaaccagcgtgttggtcaggaatacgcgaaactggttgaacagaaaaaccgtttcgaacagaaaaacttcgttggtcaggaacacctggttcacctggttaaccagctgcagcaggacatgaaagaagcgtctccgggtctggaatctaaagaacagaccgcgcactacgttaccggtcgtgcgctgcgtggttctgacaaagttttcgaaaaatggggtaaactggcgccggacgcgccgttcgacctgtacgacgcggaaatcaaaaacgttcagcgtcgtaacacccgtcgtttcggttctcacgacctgttcgcgaaactggcggaaccggaataccaggcgctgtggcgtgaagacgcgtctttcctgacccgttacgcggtttacaactctatcctgcgtaaactgaaccacgcgaaaatgttcgcgaccttcaccctgccggacgcgaccgcgcacccgatctggacccgtttcgacaaactgggtggtaacctgcaccagtacaccttcctgttcaacgaattcggtgaacgtcgtcacgcgatccgtttccacaaactgctgaaagttgaaaacggtgttgcgcgtgaagttgacgacgttaccgttccgatctctatgtctgaacagctggacaacctgctgccgcgtgacccgaacgaaccgatcgcgctgtacttccgtgactacggtgcggaacagcacttcaccggtgaattcggtggtgcgaaaatccagtgccgtcgtgaccagctggcgcacatgcaccgtcgtcgtggtgcgcgtgacgtttacctgaacgtttctgttcgtgttcagtctcagtctgaagcgcgtggtgaacgtcgtccgccgtacgcggcggttttccgtctggttggtgacaaccaccgtgcgttcgttcacttcgacaaactgtctgactacctggcggaacacccggacgacggtaaactgggttctgaaggtctgctgtctggtctgcgtgttatgtctgttgacctgggtctgcgtacctctgcgtctatctctgttttccgtgttgcgcgtaaagacgaactgaaaccgaactctaaaggtcgtgttccgttcttcttcccgatcaaaggtaacgacaacctggttgcggttcacgaacgttctcagctgctgaaactgccgggtgaaaccgaatctaaagacctgcgtgcgatccgtgaagaacgtcagcgtaccctgcgtcagctgcgtacccagctggcgtacctgcgtctgctggttcgttgcggttctgaagacgttggtcgtcgtgaacgttcttgggcgaaactgatcgaacagccggttgacgcggcgaaccacatgaccccggactggcgtgaagcgttcgaaaacgaactgcagaaactgaaatctctgcacggtatctgctctgacaaagaatggatggacgcggtttacgaatctgttcgtcgtgtttggcgtcacatgggtaaacaggttcgtgactggcgtaaagacgttcgttctggtgaacgtccgaaaatccgtggttacgcgaaagacgttgttggtggtaactctatcgaacagatcgaatacctggaacgtcagtacaaattcctgaaatcttggtctttcttcggtaaagtttctggtcaggttatccgtgcggaaaaaggttctcgtttcgcgatcaccctgcgtgaacacatcgaccacgcgaaagaagaccgtctgaaaaaactggcggaccgtatcatcatggaagcgctgggttacgtttacgcgctggacgaacgtggtaaaggtaaatgggttgcgaaatacccgccgtgccagctgatcctgctggaagaactgtctgaataccagttcaacaacgaccgtccgccgtctgaaaacaaccagctgatgcagtggtctcaccgtggtgttttccaggaactgatcaaccaggcgcaggttcacgacctgctggttggtaccatgtacgcggcgttctcttctcgtttcgacgcgcgtaccggtgcgccgggtatccgttgccgtcgtgttccggcgcgttgcacccaggaacacaacccggaaccgttcccgtggtggctgaacaaattcgttgttgaacacaccctggacgcgtgcccgctgcgtgcggacgacctgatcccgaccggtgaaggtgaaatcttcgtttctccgttctctgcggaagaaggtgacttccaccagatccacgcggacctgaacgcggcgcagaacctgcagcagcgtctgtggtctgacttcgacatctctcagatccgtctgcgttgcgactggggtgaagttgacggtgaactggttctgatcccgcgtctgaccggtaaacgtaccgcggactcttactctaacaaagttttctacaccaacaccggtgttacctactacgaacgtgaacgtggtaaaaaacgtcgtaaagttttcgcgcaggaaaaactgtctgaagaagaagcggaactgctggttgaagcggacgaagcgcgtgaaaaatctgttgttctgatgcgtgacccgtctggtatcatcaaccgtggtaactggacccgtcagaaagaattctggtctatggttaaccagcgtatcgaaggttacctggttaaacagatccgttctcgtgttccgctgcaggactctgcgtgcgaaaacaccggtgacatctaa

SEQ ID NO: 54 - DNA, 3327 bp, Artificial Sequence
  Description of Artificial Sequence: Synthetic polynucleotide
atggcgacccgttctttcatcctgaaaatcgaaccgaacgaagaagttaaaaaaggtctgtggaaaacccacgaagttctgaaccacggtatcgcgtactacatgaacatcctgaaactgatccgtcaggaagcgatctacgaacaccacgaacaggacccgaaaaacccgaaaaaagtttctaaagcggaaatccaggcggaactgtgggacttcgttctgaaaatgcagaaatgcaactctttcacccacgaagttgacaaagacgttgttttcaacatcctgcgtgaactgtacgaagaactggttccgtcttctgttgaaaaaaaaggtgaagcgaaccagctgtctaacaaattcctgtacccgctggttgacccgaactctcagtctggtaaaggtaccgcgtcttctggtcgtaaaccgcgttggtacaacctgaaaatcgcgggtgacccgtcttgggaagaagaaaaaaaaaaatgggaagaagacaaaaaaaaagacccgctggcgaaaatcctgggtaaactggcggaatacggtctgatcccgctgttcatcccgttcaccgactctaacgaaccgatcgttaaagaaatcaaatggatggaaaaatctcgtaaccagtctgttcgtcgtctggacaaagacatgttcatccaggcgctggaacgtttcctgtcttgggaatcttggaacctgaaagttaaagaagaatacgaaaaagttgaaaaagaacacaaaaccctggaagaacgtatcaaagaagacatccaggcgttcaaatctctggaacagtacgaaaaagaacgtcaggaacagctgctgcgtgacaccctgaacaccaacgaataccgtctgtctaaacgtggtctgcgtggttggcgtgaaatcatccagaaatggctgaaaatggacgaaaacgaaccgtctgaaaaatacctggaagttttcaaagactaccagcgtaaacacccgcgtgaagcgggtgactactctgtttacgaattcctgtctaaaaaagaaaaccacttcatctggcgtaaccacccggaatacccgtacctgtacgcgaccttctgcgaaatcgacaaaaaaaaaaaagacgcgaaacagcaggcgaccttcaccctggcggacccgatcaaccacccgctgtgggttcgtttcgaagaacgttctggttctaacctgaacaaataccgtatcctgaccgaacagctgcacaccgaaaaactgaaaaaaaaactgaccgttcagctggaccgtctgatctacccgaccgaatctggtggttgggaagaaaaaggtaaagttgacatcgttctgctgccgtctcgtcagttctacaaccagatcttcctggacatcgaagaaaaaggtaaacacgcgttcacctacaaagacgaatctatcaaattcccgctgaaaggtaccctgggtggtgcgcgtgttcagttcgaccgtgaccacctgcgtcgttacccgcacaaagttgaatctggtaacgttggtcgtatctacttcaacatgaccgttaacatcgaaccgaccgaatctccggtttctaaatctctgaaaatccaccgtgacgacttcccgaaattcgttaacttcaaaccgaaagaactgaccgaatggatcaaagactctaaaggtaaaaaactgaaatctggtatcgaatctctggaaatcggtctgcgtgttatgtctatcgacctgggtcagcgtcaggcggcggcggcgtctatcttcgaagttgttgaccagaaaccggacatcgaaggtaaactgttcttcccgatcaaaggtaccgaactgtacgcggttcaccgtgcgtctttcaacatcaaactgccgggtgaaaccctggttaaatctcgtgaagttctgcgtaaagcgcgtgaagacaacctgaaactgatgaaccagaaactgaacttcctgcgtaacgttctgcacttccagcagttcgaagacatcaccgaacgtgaaaaacgtgttaccaaatggatctctcgtcaggaaaactctgacgttccgctggtttaccaggacgaactgatccagatccgtgaactgatgtacaaaccgtacaaagactgggttgcgttcctgaaacagctgcacaaacgtctggaagttgaaatcggtaaagaagttaaacactggcgtaaatctctgtctgacggtcgtaaaggtctgtacggtatctctctgaaaaacatcgacgaaatcgaccgtacccgtaaattcctgctgcgttggtctctgcgtccgaccgaaccgggtgaagttcgtcgtctggaaccgggtcagcgtttcgcgatcgaccagctgaaccacctgaacgcgctgaaagaagaccgtctgaaaaaaatggcgaacaccatcatcatgcacgcgctgggttactgctacgacgttcgtaaaaaaaaatggcaggcgaaaaacccggcgtgccagatcatcctgttcgaagacctgtctaactacaacccgtacgaagaacgttctcgtttcgaaaactctaaactgatgaaatggtctcgtcgtgaaatcccgcgtcaggttgcgctgcagggtgaaatctacggtctgcaggttggtgaagttggtgcgcagttctcttctcgtttccacgcgaaaaccggttctccgggtatccgttgctctgttgttaccaaagaaaaactgcaggacaaccgtttcttcaaaaacctgcagcgtgaaggtcgtctgaccctggacaaaatcgcggttctgaaagaaggtgacctgtacccggacaaaggtggtgaaaaattcatctctctgtctaaagaccgtaaactggttaccacccacgcggacatcaacgcggcgcagaacctgcagaaacgtttctggacccgtacccacggtttctacaaagtttactgcaaagcgtaccaggttgacggtcagaccgtttacatcccggaatctaaagaccagaaacagaaaatcatcgaagaattcggtgaaggttacttcatcctgaaagacggtgtttacgaatggggtaacgcgggtaaactgaaaatcaaaaaaggttcttctaaacagtcttcttctgaactggttgactctgacatcctgaaagactctttcgacctggcgtctgaactgaaaggtgaaaaactgatgctgtaccgtgacccgtctggtaacgttttcccgtctgacaaatggatggcggcgggtgttttcttcggtaaactggaacgtatcctgatctctaaactgaccaaccagtactctatctctaccatcgaagacgactcttctaaacagtctatgtaa

SEQ ID NO: 55 - DNA, 3450 bp, Artificial Sequence
  Description of Artificial Sequence: Synthetic polynucleotide
atgccgacccgtaccatcaacctgaaactggttctgggtaaaaacccggaaaacgcgaccctgcgtcgtgcgctgttctctacccaccgtctggttaaccaggcgaccaaacgtatcgaagaattcctgctgctgtgccgtggtgaagcgtaccgtaccgttgacaacgaaggtaaagaagcggaaatcccgcgtcacgcggttcaggaagaagcgctggcgttcgcgaaagcggcgcagcgtcacaacggttgcatctctacctacgaagaccaggaaatcctggacgttctgcgtcagctgtacgaacgtctggttccgtctgttaacgaaaacaacgaagcgggtgacgcgcaggcggcgaacgcgtgggtttctccgctgatgtctgcggaatctgaaggtggtctgtctgtttacgacaaagttctggacccgccgccggtttggatgaaactgaaagaagaaaaagcgccgggttgggaagcggcgtctcagatctggatccagtctgacgaaggtcagtctctgctgaacaaaccgggttctccgccgcgttggatccgtaaactgcgttctggtcagccgtggcaggacgacttcgtttctgaccagaaaaaaaaacaggacgaactgaccaaaggtaacgcgccgctgatcaaacagctgaaagaaatgggtctgctgccgctggttaacccgttcttccgtcacctgctggacccggaaggtaaaggtgtttctccgtgggaccgtctggcggttcgtgcggcggttgcgcacttcatctcttgggaatcttggaaccaccgtacccgtgcggaatacaactctctgaaactgcgtcgtgacgaattcgaagcggcgtctgacgaattcaaagacgacttcaccctgctgcgtcagtacgaagcgaaacgtcactctaccctgaaatctatcgcgctggcggacgactctaacccgtaccgtatcggtgttcgttctctgcgtgcgtggaaccgtgttcgtgaagaatggatcgacaaaggtgcgaccgaagaacagcgtgttaccatcctgtctaaactgcagacccagctgcgtggtaaattcggtgacccggacctgttcaactggctggcgcaggaccgtcacgttcacctgtggtctccgcgtgactctgttaccccgctggttcgtatcaacgcggttgacaaagttctgcgtcgtcgtaaaccgtacgcgctgatgaccttcgcgcacccgcgtttccacccgcgttggatcctgtacgaagcgccgggtggttctaacctgcgtcagtacgcgctggactgcaccgaaaacgcgctgcacatcaccctgccgctgctggttgacgacgcgcacggtacctggatcgaaaaaaaaatccgtgttccgctggcgccgtctggtcagatccaggacctgaccctggaaaaactggaaaaaaaaaaaaaccgtctgtactaccgttctggtttccagcagttcgcgggtctggcgggtggtgcggaagttctgttccaccgtccgtacatggaacacgacgaacgttctgaagaatctctgctggaacgtccgggtgcggtttggttcaaactgaccctggacgttgcgacccaggcgccgccgaactggctggacggtaaaggtcgtgttcgtaccccgccggaagttcaccacttcaaaaccgcgctgtctaacaaatctaaacacacccgtaccctgcagccgggtctgcgtgttctgtctgttgacctgggtatgcgtaccttcgcgtcttgctctgttttcgaactgatcgaaggtaaaccggaaaccggtcgtgcgttcccggttgcggacgaacgttctatggactctccgaacaaactgtgggcgaaacacgaacgttctttcaaactgaccctgccgggtgaaaccccgtctcgtaaagaagaagaagaacgttctatcgcgcgtgcggaaatctacgcgctgaaacgtgacatccagcgtctgaaatctctgctgcgtctgggtgaagaagacaacgacaaccgtcgtgacgcgctgctggaacagttcttcaaaggttggggtgaagaagacgttgttccgggtcaggcgttcccgcgttctctgttccagggtctgggtgcggcgccgttccgttctaccccggaactgtggcgtcagcactgccagacctactacgacaaagcggaagcgtgcctggcgaaacacatctctgactggcgtaaacgtacccgtccgcgtccgacctctcgtgaaatgtggtacaaaacccgttcttaccacggtggtaaatctatctggatgctggaatacctggacgcggttcgtaaactgctgctgtcttggtctctgcgtggtcgtacctacggtgcgatcaaccgtcaggacaccgcgcgtttcggttctctggcgtctcgtctgctgcaccacatcaactctctgaaagaagaccgtatcaaaaccggtgcggactctatcgttcaggcggcgcgtggttacatcccgctgccgcacggtaaaggttgggaacagcgttacgaaccgtgccagctgatcctgttcgaagacctggcgcgttaccgtttccgtgttgaccgtccgcgtcgtgaaaactctcagctgatgcagtggaaccaccgtgcgatcgttgcggaaaccaccatgcaggcggaactgtacggtcagatcgttgaaaacaccgcggcgggtttctcttctcgtttccacgcggcgaccggtgcgccgggtgttcgttgccgtttcctgctggaacgtgacttcgacaacgacctgccgaaaccgtacctgctgcgtgaactgtcttggatgctgggtaacaccaaagttgaatctgaagaagaaaaactgcgtctgctgtctgaaaaaatccgtccgggttctctggttccgtgggacggtggtgaacagttcgcgaccctgcacccgaaacgtcagaccctgtgcgttatccacgcggacatgaacgcggcgcagaacctgcagcgtcgtttcttcggtcgttgcggtgaagcgttccgtctggtttgccagccgcacggtgacgacgttctgcgtctggcgtctaccccgggtgcgcgtctgctgggtgcgctgcagcagctggaaaacggtcagggtgcgttcgaactggttcgtgacatgggttctacctctcagatgaaccgtttcgttatgaaatctctgggtaaaaaaaaaatcaaaccgctgcaggacaacaacggtgacgacgaactggaagacgttctgtctgttctgccggaagaagacgacaccggtcgtatcaccgttttccgtgactcttctggtatcttcttcccgtgcaacgtttggatcccggcgaaacagttctggccggcggttcgtgcgatgatctggaaagttatggcgtctcactctctgggttaa

SEQ ID NO: 56 - DNA, 3759 bp, Artificial Sequence
  Description of Artificial Sequence: Synthetic polynucleotide
atgaccaaactgcgtcaccgtcagaaaaaactgacccacgactgggcgggttctaaaaaacgtgaagttctgggttctaacggtaaactgcagaacccgctgctgatgccggttaaaaaaggtcaggttaccgaattccgtaaagcgttctctgcgtacgcgcgtgcgaccaaaggtgaaatgaccgacggtcgtaaaaacatgttcacccactctttcgaaccgttcaaaaccaaaccgtctctgcaccagtgcgaactggcggacaaagcgtaccagtctctgcactcttacctgccgggttctctggcgcacttcctgctgtctgcgcacgcgctgggtttccgtatcttctctaaatctggtgaagcgaccgcgttccaggcgtcttctaaaatcgaagcgtacgaatctaaactggcgtctgaactggcgtgcgttgacctgtctatccagaacctgaccatctctaccctgttcaacgcgctgaccacctctgttcgtggtaaaggtgaagaaacctctgcggacccgctgatcgcgcgtttctacaccctgctgaccggtaaaccgctgtctcgtgacacccagggtccggaacgtgacctggcggaagttatctctcgtaaaatcgcgtcttctttcggtacctggaaagaaatgaccgcgaacccgctgcagtctctgcagttcttcgaagaagaactgcacgcgctggacgcgaacgtttctctgtctccggcgttcgacgttctgatcaaaatgaacgacctgcagggtgacctgaaaaaccgtaccatcgttttcgacccggacgcgccggttttcgaatacaacgcggaagacccggcggacatcatcatcaaactgaccgcgcgttacgcgaaagaagcggttatcaaaaaccagaacgttggtaactacgttaaaaacgcgatcaccaccaccaacgcgaacggtctgggttggctgctgaacaaaggtctgtctctgctgccggtttctaccgacgacgaactgctggaattcatcggtgttgaacgttctcacccgtcttgccacgcgctgatcgaactgatcgcgcagctggaagcgccggaactgttcgaaaaaaacgttttctctgacacccgttctgaagttcagggtatgatcgactctgcggtttctaaccacatcgcgcgtctgtcttcttctcgtaactctctgtctatggactctgaagaactggaacgtctgatcaaatctttccagatccacaccccgcactgctctctgttcatcggtgcgcagtctctgtctcagcagctggaatctctgccggaagcgctgcagtctggtgttaactctgcggacatcctgctgggttctacccagtacatgctgaccaactctctggttgaagaatctatcgcgacctaccagcgtaccctgaaccgtatcaactacctgtctggtgttgcgggtcagatcaacggtgcgatcaaacgtaaagcgatcgacggtgaaaaaatccacctgccggcggcgtggtctgaactgatctctctgccgttcatcggtcagccggttatcgacgttgaatctgacctggcgcacctgaaaaaccagtaccagaccctgtctaacgaattcgacaccctgatctctgcgctgcagaaaaacttcgacctgaacttcaacaaagcgctgctgaaccgtacccagcacttcgaagcgatgtgccgttctaccaaaaaaaacgcgctgtctaaaccggaaatcgtttcttaccgtgacctgctggcgcgtctgacctcttgcctgtaccgtggttctctggttctgcgtcgtgcgggtatcgaagttctgaaaaaacacaaaatcttcgaatctaactctgaactgcgtgaacacgttcacgaacgtaaacacttcgttttcgtttctccgctggaccgtaaagcgaaaaaactgctgcgtctgaccgactctcgtccggacctgctgcacgttatcgacgaaatcctgcagcacgacaacctggaaaacaaagaccgtgaatctctgtggctggttcgttctggttacctgctggcgggtctgccggaccagctgtcttcttctttcatcaacctgccgatcatcacccagaaaggtgaccgtcgtctgatcgacctgatccagtacgaccagatcaaccgtgacgcgttcgttatgctggttacctctgcgttcaaatctaacctgtctggtctgcagtaccgtgcgaacaaacagtctttcgttgttacccgtaccctgtctccgtacctgggttctaaactggtttacgttccgaaagacaaagactggctggttccgtctcagatgttcgaaggtcgtttcgcggacatcctgcagtctgactacatggtttggaaagacgcgggtcgtctgtgcgttatcgacaccgcgaaacacctgtctaacatcaaaaaatctgttttctcttctgaagaagttctggcgttcctgcgtgaactgccgcaccgtaccttcatccagaccgaagttcgtggtctgggtgttaacgttgacggtatcgcgttcaacaacggtgacatcccgtctctgaaaaccttctctaactgcgttcaggttaaagtttctcgtaccaacacctctctggttcagaccctgaaccgttggttcgaaggtggtaaagtttctccgccgtctatccagttcgaacgtgcgtactacaaaaaagacgaccagatccacgaagacgcggcgaaacgtaaaatccgtttccagatgccggcgaccgaactggttcacgcgtctgacgacgcgggttggaccccgtcttacctgctgggtatcgacccgggtgaatacggtatgggtctgtctctggtttctatcaacaacggtgaagttctggactctggtttcatccacatcaactctctgatcaacttcgcgtctaaaaaatctaaccaccagaccaaagttgttccgcgtcagcagtacaaatctccgtacgcgaactacctggaacagtctaaagactctgcggcgggtgacatcgcgcacatcctggaccgtctgatctacaaactgaacgcgctgccggttttcgaagcgctgtctggtaactctcagtctgcggcggaccaggtttggaccaaagttctgtctttctacacctggggtgacaacgacgcgcagaactctatccgtaaacagcactggttcggtgcgtctcactgggacatcaaaggtatgctgcgtcagccgccgaccgaaaaaaaaccgaaaccgtacatcgcgttcccgggttctcaggtttcttcttacggtaactctcagcgttgctcttgctgcggtcgtaacccgatcgaacagctgcgtgaaatggcgaaagacacctctatcaaagaactgaaaatccgtaactctgaaatccagctgttcgacggtaccatcaaactgttcaacccggacccgtctaccgttatcgaacgtcgtcgtcacaacctgggtccgtctcgtatcccggttgcggaccgtaccttcaaaaacatctctccgtcttctctggaattcaaagaactgatcaccatcgtttctcgttctatccgtcactctccggaattcatcgcgaaaaaacgtggtatcggttctgaatacttctgcgcgtactctgactgcaactcttctctgaactctgaagcgaacgcggcggcgaacgttgcgcagaaattccagaaacagctgttcttcgaactgtaa

SEQ ID NO: 57 - DNA, 3864 bp, Artificial Sequence
  Description of Artificial Sequence: Synthetic polynucleotide
atgaaacgtatcctgaactctctgaaagttgcggcgctgcgtctgctgttccgtggtaaaggttctgaactggttaaaaccgttaaatacccgctggtttctccggttcagggtgcggttgaagaactggcggaagcgatccgtcacgacaacctgcacctgttcggtcagaaagaaatcgttgacctgatggaaaaagacgaaggtacccaggtttactctgttgttgacttctggctggacaccctgcgtctgggtatgttcttctctccgtctgcgaacgcgctgaaaatcaccctgggtaaattcaactctgaccaggtttctccgttccgtaaagttctggaacagtctccgttcttcctggcgggtcgtctgaaagttgaaccggcggaacgtatcctgtctgttgaaatccgtaaaatcggtaaacgtgaaaaccgtgttgaaaactacgcggcggacgttgaaacctgcttcatcggtcagctgtcttctgacgaaaaacagtctatccagaaactggcgaacgacatctgggactctaaagaccacgaagaacagcgtatgctgaaagcggacttcttcgcgatcccgctgatcaaagacccgaaagcggttaccgaagaagacccggaaaacgaaaccgcgggtaaacagaaaccgctggaactgtgcgtttgcctggttccggaactgtacacccgtggtttcggttctatcgcggacttcctggttcagcgtctgaccctgctgcgtgacaaaatgtctaccgacaccgcggaagactgcctggaatacgttggtatcgaagaagaaaaaggtaacggtatgaactctctgctgggtaccttcctgaaaaacctgcagggtgacggtttcgaacagatcttccagttcatgctgggttcttacgttggttggcagggtaaagaagacgttctgcgtgaacgtctggacctgctggcggaaaaagttaaacgtctgccgaaaccgaaattcgcgggtgaatggtctggtcaccgtatgttcctgcacggtcagctgaaatcttggtcttctaacttcttccgtctgttcaacgaaacccgtgaactgctggaatctatcaaatctgacatccagcacgcgaccatgctgatctcttacgttgaagaaaaaggtggttaccacccgcagctgctgtctcagtaccgtaaactgatggaacagctgccggcgctgcgtaccaaagttctggacccggaaatcgaaatgacccacatgtctgaagcggttcgttcttacatcatgatccacaaatctgttgcgggtttcctgccggacctgctggaatctctggaccgtgacaaagaccgtgaattcctgctgtctatcttcccgcgtatcccgaaaatcgacaaaaaaaccaaagaaatcgttgcgtgggaactgccgggtgaaccggaagaaggttacctgttcaccgcgaacaacctgttccgtaacttcctggaaaacccgaaacacgttccgcgtttcatggcggaacgtatcccggaagactggacccgtctgcgttctgcgccggtttggttcgacggtatggttaaacagtggcagaaagttgttaaccagctggttgaatctccgggtgcgctgtaccagttcaacgaatctttcctgcgtcagcgtctgcaggcgatgctgaccgtttacaaacgtgacctgcagaccgaaaaattcctgaaactgctggcggacgtttgccgtccgctggttgacttcttcggtctgggtggtaacgacatcatcttcaaatcttgccaggacccgcgtaaacagtggcagaccgttatcccgctgtctgttccggcggacgtttacaccgcgtgcgaaggtctggcgatccgtctgcgtgaaaccctgggtttcgaatggaaaaacctgaaaggtcacgaacgtgaagacttcctgcgtctgcaccagctgctgggtaacctgctgttctggatccgtgacgcgaaactggttgttaaactggaagactggatgaacaacccgtgcgttcaggaatacgttgaagcgcgtaaagcgatcgacctgccgctggaaatcttcggtttcgaagttccgatcttcctgaacggttacctgttctctgaactgcgtcagctggaactgctgctgcgtcgtaaatctgttatgacctcttactctgttaaaaccaccggttctccgaaccgtctgttccagctggtttacctgccgctgaacccgtctgacccggaaaaaaaaaactctaacaacttccaggaacgtctggacaccccgaccggtctgtctcgtcgtttcctggacctgaccctggacgcgttcgcgggtaaactgctgaccgacccggttacccaggaactgaaaaccatggcgggtttctacgaccacctgttcggtttcaaactgccgtgcaaactggcggcgatgtctaaccacccgggttcttcttctaaaatggttgttctggcgaaaccgaaaaaaggtgttgcgtctaacatcggtttcgaaccgatcccggacccggcgcacccggttttccgtgttcgttcttcttggccggaactgaaatacctggaaggtctgctgtacctgccggaagacaccccgctgaccatcgaactggcggaaacctctgtttcttgccagtctgtttcttctgttgcgttcgacctgaaaaacctgaccaccatcctgggtcgtgttggtgaattccgtgttaccgcggaccagccgttcaaactgaccccgatcatcccggaaaaagaagaatctttcatcggtaaaacctacctgggtctggacgcgggtgaacgttctggtgttggtttcgcgatcgttaccgttgacggtgacggttacgaagttcagcgtctgggtgttcacgaagacacccagctgatggcgctgcagcaggttgcgtctaaatctctgaaagaaccggttttccagccgctgcgtaaaggtaccttccgtcagcaggaacgtatccgtaaatctctgcgtggttgctactggaacttctaccacgcgctgatgatcaaataccgtgcgaaagttgttcacgaagaatctgttggttcttctggtctggttggtcagtggctgcgtgcgttccagaaagacctgaaaaaagcggacgttctgccgaaaaaaggtggtaaaaacggtgttgacaaaaaaaaacgtgaatcttctgcgcaggacaccctgtggggtggtgcgttctctaaaaaagaagaacagcagatcgcgttcgaagttcaggcggcgggttcttctcagttctgcctgaaatgcggttggtggttccagctgggtatgcgtgaagttaaccgtgttcaggaatctggtgttgttctggactggaaccgttctatcgttaccttcctgatcgaatcttctggtgaaaaagtttacggtttctctccgcagcagctggaaaaaggtttccgtccggacatcgaaaccttcaaaaaaatggttcgtgacttcatgcgtccgccgatgttcgaccgtaaaggtcgtccggcggcggcgtacgaacgtttcgttctgggtcgtcgtcaccgtcgttaccgtttcgacaaagttttcgaagaacgtttcggtcgttctgcgctgttcatctgcccgcgtgttggttgcggtaacttcgaccactcttctgaacagtctgcggttgttctggcgctgatcggttacatcgcggacaaagaaggtatgtctggtaaaaaactggtttacgttcgtctggcggaactgatggcggaatggaaactgaaaaaactggaacgttctcgtgttgaagaacagtcttctgcgcagtaa

SEQ ID NO: 58 - DNA, 3579 bp, Artificial Sequence
  Description of Artificial Sequence: Synthetic polynucleotide
atggcggaatctaaacagatgcagtgccgtaaatgcggtgcgtctatgaaatacgaagttatcggtctgggtaaaaaatcttgccgttacatgtgcccggactgcggtaaccacacctctgcgcgtaaaatccagaacaaaaaaaaacgtgacaaaaaatacggttctgcgtctaaagcgcagtctcagcgtatcgcggttgcgggtgcgctgtacccggacaaaaaagttcagaccatcaaaacctacaaatacccggcggacctgaacggtgaagttcacgactctggtgttgcggaaaaaatcgcgcaggcgatccaggaagacgaaatcggtctgctgggtccgtcttctgaatacgcgtgctggatcgcgtctcagaaacagtctgaaccgtactctgttgttgacttctggttcgacgcggtttgcgcgggtggtgttttcgcgtactctggtgcgcgtctgctgtctaccgttctgcagctgtctggtgaagaatctgttctgcgtgcggcgctggcgtcttctccgttcgttgacgacatcaacctggcgcaggcggaaaaattcctggcggtttctcgtcgtaccggtcaggacaaactgggtaaacgtatcggtgaatgcttcgcggaaggtcgtctggaagcgctgggtatcaaagaccgtatgcgtgaattcgttcaggcgatcgacgttgcgcagaccgcgggtcagcgtttcgcggcgaaactgaaaatcttcggtatctctcagatgccggaagcgaaacagtggaacaacgactctggtctgaccgtttgcatcctgccggactactacgttccggaagaaaaccgtgcggaccagctggttgttctgctgcgtcgtctgcgtgaaatcgcgtactgcatgggtatcgaagacgaagcgggtttcgaacacctgggtatcgacccgggtgcgctgtctaacttctctaacggtaacccgaaacgtggtttcctgggtcgtctgctgaacaacgacatcatcgcgctggcgaacaacatgtctgcgatgaccccgtactgggaaggtcgtaaaggtgaactgatcgaacgtctggcgtggctgaaacaccgtgcggaaggtctgtacctgaaagaaccgcacttcggtaactcttgggcggaccaccgttctcgtatcttctctcgtatcgcgggttggctgtctggttgcgcgggtaaactgaaaatcgcgaaagaccagatctctggtgttcgtaccgacctgttcctgctgaaacgtctgctggacgcggttccgcagtctgcgccgtctccggacttcatcgcgtctatctctgcgctggaccgtttcctggaagcggcggaatcttctcaggacccggcggaacaggttcgtgcgctgtacgcgttccacctgaacgcgccggcggttcgttctatcgcgaacaaagcggttcagcgttctgactctcaggaatggctgatcaaagaactggacgcggttgaccacctggaattcaacaaagcgttcccgttcttctctgacaccggtaaaaaaaaaaaaaaaggtgcgaactctaacggtgcgccgtctgaagaagaatacaccgaaaccgaatctatccagcagccggaagacgcggaacaggaagttaacggtcaggaaggtaacggtgcgtctaaaaaccagaaaaaattccagcgtatcccgcgtttcttcggtgaaggttctcgttctgaataccgtatcctgaccgaagcgccgcagtacttcgacatgttctgcaacaacatgcgtgcgatcttcatgcagctggaatctcagccgcgtaaagcgccgcgtgacttcaaatgcttcctgcagaaccgtctgcagaaactgtacaaacagaccttcctgaacgcgcgttctaacaaatgccgtgcgctgctggaatctgttctgatctcttggggtgaattctacacctacggtgcgaacgaaaaaaaattccgtctgcgtcacgaagcgtctgaacgttcttctgacccggactacgttgttcagcaggcgctggaaatcgcgcgtcgtctgttcctgttcggtttcgaatggcgtgactgctctgcgggtgaacgtgttgacctggttgaaatccacaaaaaagcgatctctttcctgctggcgatcacccaggcggaagtttctgttggttcttacaactggctgggtaactctaccgtttctcgttacctgtctgttgcgggtaccgacaccctgtacggtacccagctggaagaattcctgaacgcgaccgttctgtctcagatgcgtggtctggcgatccgtctgtcttctcaggaactgaaagacggtttcgacgttcagctggaatcttcttgccaggacaacctgcagcacctgctggtttaccgtgcgtctcgtgacctggcggcgtgcaaacgtgcgacctgcccggcggaactggacccgaaaatcctggttctgccggttggtgcgttcatcgcgtctgttatgaaaatgatcgaacgtggtgacgaaccgctggcgggtgcgtacctgcgtcaccgtccgcactctttcggttggcagatccgtgttcgtggtgttgcggaagttggtatggaccagggtaccgcgctggcgttccagaaaccgaccgaatctgaaccgttcaaaatcaaaccgttctctgcgcagtacggtccggttctgtggctgaactcttcttcttactctcagtctcagtacctggacggtttcctgtctcagccgaaaaactggtctatgcgtgttctgccgcaggcgggttctgttcgtgttgaacagcgtgttgcgctgatctggaacctgcaggcgggtaaaatgcgtctggaacgttctggtgcgcgtgcgttcttcatgccggttccgttctctttccgtccgtctggttctggtgacgaagcggttctggcgccgaaccgttacctgggtctgttcccgcactctggtggtatcgaatacgcggttgttgacgttctggactctgcgggtttcaaaatcctggaacgtggtaccatcgcggttaacggtttctctcagaaacgtggtgaacgtcaggaagaagcgcaccgtgaaaaacagcgtcgtggtatctctgacatcggtcgtaaaaaaccggttcaggcggaagttgacgcggcgaacgaactgcaccgtaaatacaccgacgttgcgacccgtctgggttgccgtatcgttgttcagtgggcgccgcagccgaaaccgggtaccgcgccgaccgcgcagaccgtttacgcgcgtgcggttcgtaccgaagcgccgcgttctggtaaccaggaagaccacgcgcgtatgaaatcttcttggggttacacctggggtacctactgggaaaaacgtaaaccggaagacatcctgggtatctctacccaggtttactggaccggtggtatcggtgaatcttgcccggcggttgcggttgcgctgctgggtcacatccgtgcgacctctacccagaccgaatgggaaaaagaagaagttgttttcggtcgtctgaaaaaattcttcccgtcttaa

SEQ ID NO: 59 - DNA, 2958 bp, Artificial Sequence
  Description of Artificial Sequence: Synthetic polynucleotide
atggaaaaacgtatcaacaaaatccgtaaaaaactgtctgcggacaacgcgaccaaaccggtttctcgttctggtccgatgaaaaccctgctggttcgtgttatgaccgacgacctgaaaaaacgtctggaaaaacgtcgtaaaaaaccggaagttatgccgcaggttatctctaacaacgcggcgaacaacctgcgtatgctgctggacgactacaccaaaatgaaagaagcgatcctgcaggtttactggcaggaattcaaagacgaccacgttggtctgatgtgcaaattcgcgcagccggcgtctaaaaaaatcgaccagaacaaactgaaaccggaaatggacgaaaaaggtaacctgaccaccgcgggtttcgcgtgctctcagtgcggtcagccgctgttcgtttacaaactggaacaggtttctgaaaaaggtaaagcgtacaccaactacttcggtcgttgcaacgttgcggaacacgaaaaactgatcctgctggcgcagctgaaaccggaaaaagactctgacgaagcggttacctactctctgggtaaattcggtcagcgtgcgctggacttctactctatccacgttaccaaagaatctacccacccggttaaaccgctggcgcagatcgcgggtaaccgttacgcgtctggtccggttggtaaagcgctgtctgacgcgtgcatgggtaccatcgcgtctttcctgtctaaataccaggacatcatcatcgaacaccagaaagttgttaaaggtaaccagaaacgtctggaatctctgcgtgaactggcgggtaaagaaaacctggaatacccgtctgttaccctgccgccgcagccgcacaccaaagaaggtgttgacgcgtacaacgaagttatcgcgcgtgttcgtatgtgggttaacctgaacctgtggcagaaactgaaactgtctcgtgacgacgcgaaaccgctgctgcgtctgaaaggtttcccgtctttcccggttgttgaacgtcgtgaaaacgaagttgactggtggaacaccatcaacgaagttaaaaaactgatcgacgcgaaacgtgacatgggtcgtgttttctggtctggtgttaccgcggaaaaacgtaacaccatcctggaaggttacaactacctgccgaacgaaaacgaccacaaaaaacgtgaaggttctctggaaaacccgaaaaaaccggcgaaacgtcagttcggtgacctgctgctgtacctggaaaaaaaatacgcgggtgactggggtaaagttttcgacgaagcgtgggaacgtatcgacaaaaaaatcgcgggtctgacctctcacatcgaacgtgaagaagcgcgtaacgcggaagacgcgcagtctaaagcggttctgaccgactggctgcgtgcgaaagcgtctttcgttctggaacgtctgaaagaaatggacgaaaaagaattctacgcgtgcgaaatccagctgcagaaatggtacggtgacctgcgtggtaacccgttcgcggttgaagcggaaaaccgtgttgttgacatctctggtttctctatcggttctgacggtcactctatccagtaccgtaacctgctggcgtggaaatacctggaaaacggtaaacgtgaattctacctgctgatgaactacggtaaaaaaggtcgtatccgtttcaccgacggtaccgacatcaaaaaatctggtaaatggcagggtctgctgtacggtggtggtaaagcgaaagttatcgacctgaccttcgacccggacgacgaacagctgatcatcctgccgctggcgttcggtacccgtcagggtcgtgaattcatctggaacgacctgctgtctctggaaaccggtctgatcaaactggcgaacggtcgtgttatcgaaaaaaccatctacaacaaaaaaatcggtcgtgacgaaccggcgctgttcgttgcgctgaccttcgaacgtcgtgaagttgttgacccgtctaacatcaaaccggttaacctgatcggtgttgaccgtggtgaaaacatcccggcggttatcgcgctgaccgacccggaaggttgcccgctgccggaattcaaagactcttctggtggtccgaccgacatcctgcgtatcggtgaaggttacaaagaaaaacagcgtgcgatccaggcggcgaaagaagttgaacagcgtcgtgcgggtggttactctcgtaaattcgcgtctaaatctcgtaacctggcggacgacatggttcgtaactctgcgcgtgacctgttctaccacgcggttacccacgacgcggttctggttttcgaaaacctgtctcgtggtttcggtcgtcagggtaaacgtaccttcatgaccgaacgtcagtacaccaaaatggaagactggctgaccgcgaaactggcgtacgaaggtctgacctctaaaacctacctgtctaaaaccctggcgcagtacacctctaaaacctgctctaactgcggtttcaccatcaccaccgcggactacgacggtatgctggttcgtctgaaaaaaacctctgacggttgggcgaccaccctgaacaacaaagaactgaaagcggaaggtcagatcacctactacaaccgttacaaacgtcagaccgttgaaaaagaactgtctgcggaactggaccgtctgtctgaagaatctggtaacaacgacatctctaaatggaccaaaggtcgtcgtgacgaagcgctgttcctgctgaaaaaacgtttctctcaccgtccggttcaggaacagttcgtttgcctggactgcggtcacgaagttcacgcggacgaacaggcggcgctgaacatcgcgcgttcttggctgttcctgaactctaactctaccgaattcaaatcttacaaatctggtaaacagccgttcgttggtgcgtggcaggcgttctacaaacgtcgtctgaaagaagtttggaaaccgaacgcg

SEQ ID NO: 60 - DNA, 2919 bp, Artificial Sequence
  Description of Artificial Sequence: Synthetic polynucleotide
atgaaacgtatcaacaaaatccgtcgtcgtctggttaaagactctaacaccaaaaaagcgggtaaaaccggtccgatgaaaaccctgctggttcgtgttatgaccccggacctgcgtgaacgtctggaaaacctgcgtaaaaaaccggaaaacatcccgcagccgatctctaacacctctcgtgcgaacctgaacaaactgctgaccgactacaccgaaatgaaaaaagcgatcctgcacgtttactgggaagaattccagaaagacccggttggtctgatgtctcgtgttgcgcagccggcgccgaaaaacatcgaccagcgtaaactgatcccggttaaagacggtaacgaacgtctgacctcttctggtttcgcgtgctctcagtgctgccagccgctgtacgtttacaaactggaacaggttaacgacaaaggtaaaccgcacaccaactacttcggtcgttgcaacgtttctgaacacgaacgtctgatcctgctgtctccgcacaaaccggaagcgaacgacgaactggttacctactctctgggtaaattcggtcagcgtgcgctggacttctactctatccacgttacccgtgaatctaaccacccggttaaaccgctggaacagatcggtggtaactcttgcgcgtctggtccggttggtaaagcgctgtctgacgcgtgcatgggtgcggttgcgtctttcctgaccaaataccaggacatcatcctggaacaccagaaagttatcaaaaaaaacgaaaaacgtctggcgaacctgaaagacatcgcgtctgcgaacggtctggcgttcccgaaaatcaccctgccgccgcagccgcacaccaaagaaggtatcgaagcgtacaacaacgttgttgcgcagatcgttatctgggttaacctgaacctgtggcagaaactgaaaatcggtcgtgacgaagcgaaaccgctgcagcgtctgaaaggtttcccgtctttcccgctggttgaacgtcaggcgaacgaagttgactggtgggacatggtttgcaacgttaaaaaactgatcaacgaaaaaaaagaagacggtaaagttttctggcagaacctggcgggttacaaacgtcaggaagcgctgctgccgtacctgtcttctgaagaagaccgtaaaaaaggtaaaaaattcgcgcgttaccagttcggtgacctgctgctgcacctggaaaaaaaacacggtgaagactggggtaaagtttacgacgaagcgtgggaacgtatcgacaaaaaagttgaaggtctgtctaaacacatcaaactggaagaagaacgtcgttctgaagacgcgcagtctaaagcggcgctgaccgactggctgcgtgcgaaagcgtctttcgttatcgaaggtctgaaagaagcggacaaagacgaattctgccgttgcgaactgaaactgcagaaatggtacggtgacctgcgtggtaaaccgttcgcgatcgaagcggaaaactctatcctggacatctctggtttctctaaacagtacaactgcgcgttcatctggcagaaagacggtgttaaaaaactgaacctgtacctgatcatcaactacttcaaaggtggtaaactgcgtttcaaaaaaatcaaaccggaagcgttcgaagcgaaccgtttctacaccgttatcaacaaaaaatctggtgaaatcgttccgatggaagttaacttcaacttcgacgacccgaacctgatcatcctgccgctggcgttcggtaaacgtcagggtcgtgaattcatctggaacgacctgctgtctctggaaaccggttctctgaaactggcgaacggtcgtgttatcgaaaaaaccctgtacaaccgtcgtacccgtcaggacgaaccggcgctgttcgttgcgctgaccttcgaacgtcgtgaagttctggactcttctaacatcaaaccgatgaacctgatcggtatcgaccgtggtgaaaacatcccggcggttatcgcgctgaccgacccggaaggttgcccgctgtctcgtttcaaagactctctgggtaacccgacccacatcctgcgtatcggtgaatcttacaaagaaaaacagcgtaccatccaggcggcgaaagaagttgaacagcgtcgtgcgggtggttactctcgtaaatacgcgtctaaagcgaaaaacctggcggacgacatggttcgtaacaccgcgcgtgacctgctgtactacgcggttacccaggacgcgatgctgatcttcgaaaacctgtctcgtggtttcggtcgtcagggtaaacgtaccttcatggcggaacgtcagtacacccgtatggaagactggctgaccgcgaaactggcgtacgaaggtctgccgtctaaaacctacctgtctaaaaccctggcgcagtacacctctaaaacctgctctaactgcggtttcaccatcacctctgcggactacgaccgtgttctggaaaaactgaaaaaaaccgcgaccggttggatgaccaccatcaacggtaaagaactgaaagttgaaggtcagatcacctactacaaccgttacaaacgtcagaacgttgttaaagacctgtctgttgaactggaccgtctgtctgaagaatctgttaacaacgacatctcttcttggaccaaaggtcgttctggtgaagcgctgtctctgctgaaaaaacgtttctctcaccgtccggttcaggaaaaattcgtttgcctgaactgcggtttcgaaacccacgcggacgaacaggcggcgctgaacatcgcgcgttcttggctgttcctgcgttctcaggaatacaaaaaataccagaccaacaaaaccaccggtaacaccgacaaacgtgcgttcgttgaaacctggcagtctttctaccgtaaaaaactgaaagaagtttggaaaccg

SEQ ID NO: 61 - DNA, 4859 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgggtaaaatgtattaccttggtttagacattggcacgaattccgtgggctacgcggtgaccgacccctcataccacctgctgaagtttaagggggaaccaatgtggggtgcgcacgtatttgccgccggtaatcagagcgcggaacgacgctcgttccgcacatcgcgtcgtcgtttggaccgacgccaacagcgcgttaaactggtacaggagatttttgccccggtgattagtccgatcgacccacgcttcttcattcgtctgcatgaatccgccctgtggcgcgatgacgtcgcggagacggataaacatatctttttcaatgatcctacctataccgataaggaatattatagcgattacccgactatccatcacctgatcgttgatctgatggaaagctctgagaaacacgatccgcggctggtgtaccttgcagtggcgtggttagtggcacaccgtggtcattttctgaacgaggtggacaaggataatattggagatgtgttgtcgttcgacgcattttatccggagtttctcgcgttcctgtcggacaacggtgtatcaccgtgggtgtgcgaaagcaaagcgctgcaggcgaccttgctgagccgtaactcagtgaacgacaaatataaagcccttaagtctctgatcttcggatcccagaaacctgaagataacttcgatgccaatatttcggaagatggactcattcaactgctggccggcaaaaaggtaaaagttaacaaactgttccctcaggaatcgaacgatgcatccttcacattgaatgataaagaagacgcgatagaagaaatcctgggtacgcttacaccagatgaatgtgaatggattgcgcatatacgccgcctttttgactgggctatcatgaaacatgctctgaaagatggcaggactattagcgagtcaaaagtcaaactgtatgagcagcaccatcacgatctgacccaacttaaatacttcgtgaaaacctaccttgcaaaagaatacgacgatattttccgcaacgtggatagcgaaacaacgaaaaactatgtagcgtattcctatcatgtgaaagaggtgaaaggcactctgcctaaaaataaggcaacgcaagaagagttttgtaagtatgtcctgggcaaggttaaaaacattgaatgctctgaagcagacaaggttgactttgatgagatgattcagcgtcttaccgacaactcttttatgcctaagcaggtttcgggcgaaaaccgcgttattccttatcagttatattattatgaactgaagacaattctgaataaagcagcctcgtacctgcctttcctgacgcagtgtggaaaagatgcaatttcgaaccaggacaaactactgtcgatcatgacgttccgtattccttacttcgtcggacccttgcgaaaagataattcggaacatgcatggctcgaacgaaaggccggtaagatttatccgtggaactttaacgacaaagtggacttggataaatcagaagaagcgttcattcgccgaatgaccaatacctgtacctattatcccggcgaagatgttttaccgttggattcgctgatctatgagaaatttatgattttaaatgaaatcaataatattcgtattgacggctacccgattagtgttgacgttaaacagcaggtttttggcttgttcgaaaaaaaacgacgcgtaaccgtgaaagatattcagaacctgctgctgtctctcggagctctggacaaacacgggaagctgacaggcatcgataccactatccactcaaactataatacgtatcaccattttaaatctctcatggaacgcggcgtcctgacccgggatgacgtggaacgcatcgttgaaaggatgacctacagcgacgatactaagcgtgtgcgtctgtggctgaataacaactatggtactttaaccgccgacgatgtgaaacacatttcgcgtctgcgcaaacacgattttggccgtttatccaaaatgttcttaacaggtctgaagggtgtccataaggagaccggtgaacgtgcctccatactggatttcatgtggaacacgaacgataacctgatgcagctcctttccgaatgctacacgttcagtgatgaaatcacaaagctgcaagaggcgtattatgcaaaagcccagttgtctttaaacgattttttagactcgatgtacatctctaacgcggtgaaacgtccgatttacagaactctggcagtggtgaacgatattcgaaaagcatgtgggacggcccctaaacgcattttcatcgaaatggctcgtgatggtgaatcaaaaaaaaagagaagtgttacacgtcgcgagcagatcaaaaacctgtaccgctcgattcgtaaagatttccagcaggaagttgattttctggaaaagatcctggaaaataaatctgatggtcaacttcagtcagatgctttgtatctttactttgcacaattagggcgcgatatgtacacgggcgatccaataaagctggagcacatcaaagatcagagtttctataacatagaccatatttacccgcagtctatggtgaaagacgattccctagataacaaagtgctggtgcaaagcgaaattaacggcgagaaaagctcgcgataccctttggacgccgcgatccgcaataaaatgaagcccctttgggacgcttactataatcatggcctgatctccttaaagaaataccagcgtctaacgcgctcgaccccgtttaccgatgatgaaaaatgggactttattaatcgccagttagtggaaacccgtcaatctaccaaagcgctggccattttgttgaagcgtaagtttccagacaccgaaattgtgtattcgaaggcggggttatcgtccgacttcagacatgaattcggccttgtaaaaagtcgcaatattaatgatttgcaccacgctaaagacgcattcttggctatcgttaccggcaatgtgtaccatgaaagattcaatcgcagatggtttatggtgaaccagccgtactcagttaaaactaaaactctttttacccacagcataaagaatggcaacttcgttgcctggaacggcgaagaagatctcggtcgtattgtaaaaatgctgaagcaaaacaaaaataccattcacttcacgcgcttctccttcgatcgcaaagaaggattatttgatatccaacctctgaaagccagcaccggcttagtcccacgaaaagccggtctggatgtcgttaaatacggcggatatgacaaatctaccgcggcctattacctgctggtgaggttcacgctcgaggacaagaaaacccagcacaagctgatgatgattcctgtagaaggcctgtacaaggctcgcattgatcatgacaaggaatttcttaccgattatgcgcaaacgactataagcgaaatcctacagaaagataaacagaaagtgatcaatattatgtttccaatgggtacgaggcatataaaactcaattcaatgattagtatcgatggcttctatcttagtatcggcggaaagtcctctaaaggtaagtcagttctatgtcacgcaatggttccactgatcgtccctcacaaaatcgaatgttacattaaagcaatggaaagcttcgcccggaagtttaaagaaaacaacaagctgcgcatcgtagaaaaattcgataaaatcaccgttgaagacaacctgaatctctacgagctctttctccaaaaactgcagcataatccctataataagtttttttcgacacagtttgacgtactgacgaacggccgttctactttcacaaaactgtcgccggaggaacaggtacagacgctcttgaacattttaagtatctttaaaacatgccgcagttcgggttgcgacctgaaatccatcaacggcagtgcccaggcagcgcgcatcatgattagcgctgacttaactggactgtcgaaaaaatattcagatattaggttggttgaacagtcagcttctggtttgttcgtatccaaaagtcagaacttactggagtatctctaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 62 - DNA, 4787 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgtcatcgctcacgaaattcactaacaaatactctaaacagctcaccattaagaatgaactcatcccagttggcaaaacactggagaacatcaaagagaatggtctgatagatggcgacgaacagctgaatgagaattatcagaaggcgaaaattattgtggatgattttctgcgggacttcattaataaagcactgaataatacgcagatcgggaactggcgcgaactggcggatgcccttaataaagaggatgaagataacatcgagaaattgcaggataaaattcggggaatcattgtatccaaatttgaaacgtttgatctgtttagcagctattctattaagaaagatgaaaagattattgacgacgacaatgatgttgaagaagaggaactggatctgggcaagaagaccagctcatttaaatacatatttaaaaaaaacctgtttaagttagtgttgccatcctacctgaaaaccacaaaccaggacaagctgaagattattagctcgtttgataatttttcaacgtacttccgcgggttctttgaaaaccggaaaaacatttttaccaagaaaccgatctccacaagtattgcgtatcgcattgttcatgataacttcccgaaattccttgataacattcgttgttttaatgtgtggcagacggaatgcccgcaactaatcgtgaaagcagataactatctgaaaagcaaaaatgttatagcgaaagataaaagtttggcaaactattttaccgtgggcgcgtatgactatttcctgtctcagaatggtatagatttttacaacaatattataggtggactgccagcgttcgccggccatgagaaaatccaaggtctcaatgaattcatcaatcaagagtgccaaaaagacagcgagctgaaaagtaagctgaaaaaccgtcacgcgttcaaaatggcggtactgttcaaacagatactcagcgatcgtgaaaaaagttttgtaattgatgagttcgagtcggatgctcaagttattgacgccgttaaaaacttttacgccgaacagtgcaaagataacaatgttatttttaacttattaaatcttatcaagaatatcgctttcttaagtgatgacgaactggacggcatattcattgaagggaaatacctgtcgagcgttagtcaaaaactctatagcgattggtcaaaattacgtaacgacattgaggattcggctaactctaaacaaggcaataaagagctggccaagaagatcaaaaccaacaaaggggatgtagaaaaagcgatctcgaaatatgagttctcgctgtcggaactgaactcgattgtacatgataacaccaagttttctgacctccttagttgtacactgcataaggtggcttctgagaaactggtgaaggtcaatgaaggcgactggccgaaacatctcaagaataatgaagagaaacaaaaaatcaaagagccgcttgatgctctgctggagatctataatacacttctgatttttaactgcaaaagcttcaataaaaacggcaacttctatgtcgactatgatcgttgcatcaatgaactgagttcggtcgtgtatctgtataataaaacacgtaactattgcactaaaaaaccctataacacggacaagttcaaactcaattttaacagtccgcagctcggtgaaggcttttccaagtcgaaagaaaatgactgtctgactcttttgtttaaaaaagacgacaactattatgtaggcattatccgcaaaggtgcaaaaatcaattttgatgatacacaagcaatcgccgataacaccgacaattgcatctttaaaatgaattatttcctacttaaagacgcaaaaaaatttatcccgaaatgtagcattcagctgaaagaagtcaaggcccattttaagaaatctgaagatgattacattttgtctgataaagagaaatttgctagcccgctggtcattaaaaagagcacatttttgctggcaactgcacatgtgaaagggaaaaaaggcaatatcaagaaatttcagaaagaatattcgaaagaaaaccccactgagtatcgcaattctttaaacgaatggattgctttttgtaaagagttcttaaaaacttataaagcggctaccatttttgatataaccacattgaaaaaggcagaggaatatgctgatattgtagaattctacaaggatgtcgataatctgtgctacaaactggagttctgcccgattaaaacctcgtttatagaaaacctgatagataacggcgacctgtatctgtttcgcatcaataacaaagacttcagcagtaaatcgaccggcaccaagaaccttcatacgttatatttacaagctatattcgatgaacgtaatctgaacaatccgacaattatgctgaatgggggagcagaactgttctatcgtaaagaaagtattgagcagaaaaaccgtatcacacacaaagccggttcaattctcgtgaataaggtgtgtaaagacggtacaagcctggatgataagatacgtaatgaaatttatcaatatgagaataaatttattgataccctgtctgatgaagctaaaaaggtgttaccgaatgtcattaaaaaggaagctacccatgacattacaaaagataaacgtttcactagtgacaaattcttctttcactgccccctgacaattaattataaggaaggcgataccaagcagttcaataacgaagtgctgagttttctgcgtggaaatcctgacatcaacattatcggcattgaccgcggagagcgtaatttaatctatgtaacggttataaaccagaaaggcgagattctggattcggtttcattcaataccgtgaccaacaagagttcaaaaatcgagcagacagtcgattatgaagagaaattggcagtccgcgagaaagagaggattgaagcaaaacgttcctgggactctatctcaaaaattgcgacactaaaggaaggttatctgagcgcaatagttcacgagatctgtctgttaatgattaaacacaacgcgatcgttgtcttagagaatcttaatgcaggctttaagcgtattcgtggcggtttatcagaaaaaagtgtttatcaaaaattcgaaaaaatgttgattaacaaactgaactattttgtcagcaagaaggaatccgactggaataaaccgtctggtctgctgaatggactgcagctttcggatcagtttgaaagcttcgaaaaactgggtattcagtctggttttattttttacgtgccggctgcatatacctcaaagattgatccgaccacgggcttcgccaatgttctgaatctgtcgaaggtacgcaatgttgatgcgatcaaaagctttttttctaacttcaacgaaattagttatagcaagaaagaagcccttttcaaattctcattcgatctggattcactgagtaagaaaggctttagtagctttgtgaaatttagtaagagtaaatggaacgtctacacctttggagaacgtatcataaagccaaagaataagcaaggttatcgggaggacaaaagaatcaacttgaccttcgagatgaagaagttacttaacgagtataaggtttcttttgatcttgaaaataacttgattccgaatctcacgagtgccaacctgaaggatactttttggaaagagctattctttatcttcaagactacgctgcagctccgtaacagcgttactaacggtaaagaagatgtgctcatctctccggtcaaaaatgcgaagggtgaattcttcgtttcgggaacgcataacaagactcttccgcaagattgcgatgcgaacggtgcataccatattgcgttgaaaggtctgatgatactcgaacgtaacaaccttgtacgtgaggagaaagatacgaaaaagattatggcgatttcaaacgtggattggttcgagtacgtgcagaaacgtagaggcgttctgtaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 63 - DNA, 4249 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataacaactacgacgaattcaccaaactgtacccgatccagaaaaccatccgtttcgaactgaaaccgcagggtcgtaccatggaacacctggaaaccttcaacttcttcgaagaagaccgtgaccgtgcggaaaaatacaaaatcctgaaagaagcgatcgacgaataccacaaaaaattcatcgacgaacacctgaccaacatgtctctggactggaactctctgaaacagatctctgaaaaatactacaaatctcgtgaagaaaaagacaaaaaagttttcctgtctgaacagaaacgtatgcgtcaggaaatcgtttctgaattcaaaaaagacgaccgtttcaaagacctgttctctaaaaaactgttctctgaactgctgaaagaagaaatctacaaaaaaggtaaccaccaggaaatcgacgcgctgaaatctttcgacaaattctctggttacttcatcggtctgcacgaaaaccgtaaaaacatgtactctgacggtgacgaaatcaccgcgatctctaaccgtatcgttaacgaaaacttcccgaaattcctggacaacctgcagaaataccaggaagcgcgtaaaaaatacccggaatggatcatcaaagcggaatctgcgctggttgcgcacaacatcaaaatggacgaagttttctctctggaatacttcaacaaagttctgaaccaggaaggtatccagcgttacaacctggcgctgggtggttacgttaccaaatctggtgaaaaaatgatgggtctgaacgacgcgctgaacctggcgcaccagtctgaaaaatcttctaaaggtcgtatccacatgaccccgctgttcaaacagatcctgtctgaaaaagaatctttctcttacatcccggacgttttcaccgaagactctcagctgctgccgtctatcggtggtttcttcgcgcagatcgaaaacgacaaagacggtaacatcttcgaccgtgcgctggaactgatctcttcttacgcggaatacgacaccgaacgtatctacatccgtcaggcggacatcaaccgtgtttctaacgttatcttcggtgaatggggtaccctgggtggtctgatgcgtgaatacaaagcggactctatcaacgacatcaacctggaacgtacctgcaaaaaagttgacaaatggctggactctaaagaattcgcgctgtctgacgttctggaagcgatcaaacgtaccggtaacaacgacgcgttcaacgaatacatctctaaaatgcgtaccgcgcgtgaaaaaatcgacgcggcgcgtaaagaaatgaaattcatctctgaaaaaatctctggtgacgaagaatctatccacatcatcaaaaccctgctggactctgttcagcagttcctgcacttcttcaacctgttcaaagcgcgtcaggacatcccgctggacggtgcgttctacgcggaattcgacgaagttcactctaaactgttcgcgatcgttccgctgtacaacaaagttcgtaactacctgaccaaaaacaacctgaacaccaaaaaaatcaaactgaacttcaaaaacccgaccctggcgaacggttgggaccagaacaaagtttacgactacgcgtctctgatcttcctgcgtgacggtaactactacctgggtatcatcaacccgaaacgtaaaaaaaacatcaaattcgaacagggttctggtaacggtccgttctaccgtaaaatggtttacaaacagatcccgggtccgaacaaaaacctgccgcgtgttttcctgacctctaccaaaggtaaaaaagaatacaaaccgtctaaagaaatcatcgaaggttacgaagcggacaaacacatccgtggtgacaaattcgacctggacttctgccacaaactgatcgacttcttcaaagaatctatcgaaaaacacaaagactggtctaaattcaacttctacttctctccgaccgaatcttacggtgacatctctgaattctacctggacgttgaaaaacagggttaccgtatgcacttcgaaaacatctctgcggaaaccatcgacgaatacgttgaaaaaggtgacctgttcctgttccagatctacaacaaagacttcgttaaagcggcgaccggtaaaaaagacatgcacaccatctactggaacgcggcgttctctccggaaaacctgcaggacgttgttgttaaactgaacggtgaagcggaactgttctaccgtgacaaatctgacatcaaagaaatcgttcaccgtgaaggtgaaatcctggttaaccgtacctacaacggtcgtaccccggttccggacaaaatccacaaaaaactgaccgactaccacaacggtcgtaccaaagacctgggtgaagcgaaagaatacctggacaaagttcgttacttcaaagcgcactacgacatcaccaaagaccgtcgttacctgaacgacaaaatctacttccacgttccgctgaccctgaacttcaaagcgaacggtaaaaaaaacctgaacaaaatggttatcgaaaaattcctgtctgacgaaaaagcgcacatcatcggtatcgaccgtggtgaacgtaacctgctgtactactctatcatcgaccgttctggtaaaatcatcgaccagcagtctctgaacgttatcgacggtttcgactaccgtgaaaaactgaaccagcgtgaaatcgaaatgaaagacgcgcgtcagtcttggaacgcgatcggtaaaatcaaagacctgaaagaaggttacctgtctaaagcggttcacgaaatcaccaaaatggcgatccagtacaacgcgatcgttgttatggaagaactgaactacggtttcaaacgtggtcgtttcaaagttgaaaaacagatctaccagaaattcgaaaacatgctgatcgacaaaatgaactacctggttttcaaagacgcgccggacgaatctccgggtggtgttctgaacgcgtaccagctgaccaacccgctggaatctttcgcgaaactgggtaaacagaccggtatcctgttctacgttccggcggcgtacacctctaaaatcgacccgaccaccggtttcgttaacctgttcaacacctcttctaaaaccaacgcgcaggaacgtaaagaattcctgcagaaattcgaatctatctcttactctgcgaaagacggtggtatcttcgcgttcgcgttcgactaccgtaaattcggtacctctaaaaccgaccacaaaaacgtttggaccgcgtacaccaacggtgaacgtatgcgttacatcaaagaaaaaaaacgtaacgaactgttcgacccgtctaaagaaatcaaagaagcgctgacctcttctggtatcaaatacgacggtggtcagaacatcctgccggacatcctgcgttctaacaacaacggtctgatctacaccatgtactcttctttcatcgcggcgatccagatgcgtgtttacgacggtaaagaagactacatcatctctccgatcaaaaactctaaaggtgaattcttccgtaccgacccgaaacgtcgtgaactgccgatcgacgcggacgcgaacggtgcgtacaacatcgcgctgcgtggtgaactgaccatgcgtgcgatcgcggaaaaattcgacccggactctgaaaaaatggcgaaactggaactgaaacacaaagactggttcgaattcatgcagacccgtggtgactaagaaatcatccttagcgaaagctaaggattttttttatctgaaatgtagggagaccctcaggttaaatattcactcaggaagttattactcaggaagcaaagaggattaca

SEQ ID NO: 64 - DNA, 4679 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgactaaaacatttgattcagagttttttaatttgtactcgctgcaaaaaacggtacgctttgagttaaaacccgtgggagaaaccgcgtcatttgtggaagactttaaaaacgagggcttgaaacgtgttgtgagcgaagatgaaaggcgagccgtcgattaccagaaagttaaggaaataattgacgattaccatcgggatttcattgaagaaagtttaaattattttccggaacaggtgagtaaagatgctcttgagcaggcgtttcatctttatcagaaactgaaggcagcaaaagttgaggaaagggaaaaagcgctgaaagaatgggaagcgctgcagaaaaagctacgtgaaaaagtggtgaaatgcttctcggactcgaataaagcccgcttctcaaggattgataaaaaggaactgattaaggaagacctgataaattggttggtcgcccagaatcgcgaggatgatatccctacggtcgaaacgtttaacaacttcaccacatattttaccggcttccatgagaatcgtaaaaatatttactccaaagatgatcacgccaccgctattagctttcgccttattcatgaaaatcttccaaagttttttgacaacgtgattagcttcaataagttgaaagagggtttccctgaattaaaatttgataaagtgaaagaggatttagaagtagattatgatctgaagcatgcgtttgaaatagaatatttcgttaacttcgtgacccaagcgggcatagatcagtataattatctgttaggagggaaaaccctggaggacgggacgaaaaaacaagggatgaatgagcaaattaatctgttcaaacaacagcaaacgcgagataaagcgcgtcagattcccaaactgatccccctgttcaaacagattcttagcgaaaggactgaaagccagtcctttattcctaaacaatttgaaagtgatcaggagttgttcgattcactgcagaagttacataataactgccaggataaattcaccgtgctgcaacaagccattctcggtctggcagaggcggatcttaagaaggtcttcatcaaaacctctgatttaaatgccttatctaacaccattttcgggaattacagcgtcttttccgatgcactgaacctgtataaagaaagcctgaaaacgaaaaaagcgcaggaggcttttgagaaactaccggcccattctattcacgacctcattcaatacttggaacagttcaattccagcctggacgcggaaaaacaacagagcaccgacaccgtcctgaactacttcatcaagaccgatgaattatattctcgcttcattaaatccactagcgaggctttcactcaggtgcagcctttgttcgaactggaagccctgtcatctaagcgccgcccaccggaatcggaagatgaaggggcaaaagggcaggaaggcttcgagcagatcaagcgtattaaagcttacctggatacgcttatggaagcggtacactttgcaaagccgttgtatcttgttaagggtcgtaaaatgatcgaagggctcgataaagaccagtccttttatgaagcgtttgaaatggcgtaccaagaacttgaatcgttaatcattcctatctataacaaagcgcggagctatctgtcgcggaaacctttcaaggccgataaattcaagattaattttgacaacaacacgctactgagcggatgggatgcgaacaaggaaactgctaacgcgtccattctgtttaagaaagacgggttatattaccttggaattatgccgaaaggtaagacctttctctttgactactttgtatcgagcgaggattcagagaaactgaaacagcgtcgccagaagaccgccgaagaagctctggcgcaggatggtgaaagttacttcgaaaaaattcgttataaactgttaccaggggcttcaaagatgttaccgaaagtcttttttagcaacaaaaatattggcttttacaacccgtcggatgacattttacgcattcgcaacacagcctctcacaccaaaaacgggacccctcagaaaggccactcaaaagttgagtttaacctgaatgattgtcataagatgattgatttcttcaaatcatcaattcagaaacacccggaatgggggtcttttggctttacgttttctgataccagtgattttgaagacatgagtgccttctaccgggaagtagaaaaccagggttacgtaattagctttgacaaaatcaaagagacctatatacagagccaggtggaacagggtaatctctacttattccagatttataacaaggatttctcgccctacagcaaaggcaaaccaaacctgcatactctgtactggaaagccctgtttgaagaagcgaacctgaataacgtagtggcgaagttgaacggtgaagcggaaatcttcttccgtcgtcactccattaaggcctctgataaagttgtccatccggcaaatcaggccattgataataagaatccacacacggaaaaaacgcagtcaacctttgaatatgacctcgttaaagacaaacgctacacgcaagataagttctttttccacgtcccaatcagcctcaactttaaagcacaaggggtttcaaagtttaatgataaagtcaatgggttcctcaagggcaacccggatgtcaacattataggtatagacaggggcgaacgccatctgctttactttaccgtagtgaatcagaaaggtgaaatactggttcaggaatcattaaataccttgatgtcggacaaagggcacgttaatgattaccagcagaaactggataaaaaagaacaggaacgtgatgctgcgcgtaaatcgtggaccacggttgagaacattaaagagctgaaagaggggtatctaagccatgtggtacacaaactggcgcacctcatcattaaatataacgcaatagtctgcctagaagacttgaattttggctttaaacgcggccgcttcaaagtggaaaaacaagtttatcaaaaatttgaaaaggcgcttatagataaactgaattatctggtttttaaagaaaaggaacttggtgaggtagggcactacttgacagcttatcaactgacggccccgttcgaatcattcaaaaaactgggcaaacagtctggcattctgttttacgtgccggcagattatacttcaaaaatcgatccaacaactggctttgtgaacttcctggacctgagatatcagtctgtagaaaaagctaaacaacttcttagcgattttaatgccattcgttttaacagcgttcagaattactttgaattcgaaattgactataaaaaacttactccgaaacgtaaagtcggaacccaaagtaaatgggtaatttgtacgtatggcgatgtcaggtatcagaaccgtcggaatcaaaaaggtcattgggagaccgaagaagtgaacgtgaccgaaaagctgaaggctctgttcgccagcgattcaaaaactacaactgtgatcgattacgcaaatgatgataacctgatagatgtgattttagagcaggataaagccagcttttttaaagaactgttgtggctcctgaaacttacgatgaccttacgacattccaagatcaaatcggaagatgattttattctgtcaccggtcaagaatgagcagggtgaattctatgatagtaggaaagccggcgaagtgtggccgaaagacgccgacgccaatggcgcctatcatatcgcgctcaaagggctttggaatttgcagcagattaaccagtgggaaaaaggtaaaaccctgaatctggctatcaaaaaccaggattggtttagctttatccaagagaaaccgtatcaggaatgagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 65 - DNA, 4240 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatcatacaggcggtcttcttagtatggacgcgaaagagttcacaggtcagtatccgttgtcgaaaacattacgattcgaacttcggcccatcggccgcacgtgggataacctggaggcctcaggctacttagcggaagaccgccatcgtgccgaatgttatcctcgtgcgaaagagttattggatgacaaccatcgtgccttcctgaatcgtgtgttgccacaaatcgatatggattggcacccgattgcggaggccttttgtaaggtacataaaaaccctggtaataaagaacttgcccaggattacaaccttcagttgtcaaagcgccgtaaggagatcagcgcatatcttcaggatgcagatggctataaaggcctgttcgcgaagcccgccttagacgaagctatgaaaattgcgaaagaaaacgggaacgaaagtgatattgaggttctcgaagcgtttaacggttttagcgtatacttcaccggttatcatgagtcacgcgagaacatttatagcgatgaggatatggtgagcgtagcctaccgaattactgaggataatttcccgcgctttgtctcaaacgctttgatctttgataaattaaacgaaagccatccggatattatctctgaagtatcgggcaatcttggagttgatgacattggtaagtactttgacgtgtcgaactataacaattttctttcccaggccggtatagatgactacaatcacattattggcggccatacaaccgaagacggactgatacaagcgtttaatgtcgtattgaacttacgtcaccaaaaagaccctggctttgaaaaaattcagttcaaacagctctacaaacaaatcctgagcgtgcgtaccagcaaaagctacatcccgaaacagtttgacaactctaaggagatggttgactgcatttgcgattatgtcagcaaaatagagaaatccgaaacagtagaacgggccctgaaactagtccgtaatatcagttctttcgacttgcgcgggatctttgtcaataaaaagaacttgcgcatactgagcaacaaactgataggagattgggacgcgatcgaaaccgcattgatgcatagttcttcatcagaaaacgataagaaaagcgtatatgatagcgcggaggcttttacgttggatgacatcttttcaagcgtgaaaaaattttctgatgcctctgccgaagatattggcaacagggcggaagacatctgtagagtgataagtgagacggccccttttatcaacgatctgcgagcggtggacctggatagcctgaacgacgatggttatgaagcggccgtctcaaaaattcgggagtcgctggagccttatatggatcttttccatgaactggaaattttctcggttggcgatgagttcccaaaatgcgcagcattttacagcgaactggaggaagtcagcgaacagctgatcgaaattattccgttattcaacaaggcgcgttcgttctgcacccggaaacgctatagcaccgataagattaaagtgaacttaaaattcccgaccttggcggacgggtgggacctgaacaaagagagagacaacaaagccgcgattctgcggaaagacggtaagtattatctggcaattctggatatgaagaaagatctgtcaagcattaggaccagcgacgaagatgaatccagcttcgaaaagatggagtataaactgttaccgagtccagtaaaaatgctgccaaagatattcgtaaaatcgaaagccgctaaggaaaaatatggcctgacagatcgtatgcttgaatgctacgataaaggtatgcataagtcgggtagtgcgtttgatcttggcttttgccatgaactcattgattattacaagcgttgtatcgcggagtacccaggctgggatgtgttcgatttcaagtttcgcgaaacttccgattatgggtccatgaaagagttcaatgaagatgtggccggagccggttactatatgagtctgagaaaaattccgtgcagcgaagtgtaccgtctgttagacgagaaatcgatttatctatttcaaatttataacaaagattactctgaaaatgcacatggtaataagaacatgcataccatgtactgggagggtctcttttccccgcaaaacctggagtcgcccgttttcaagttgtcgggtggggcagaacttttctttcgaaaatcctcaatccctaacgatgccaaaacagtacacccgaaaggctcagtgctggttccacgtaatgatgttaacggtcggcgtattccagattcaatctaccgcgaactgacacgctattttaaccgtggcgattgccgaatcagtgacgaagccaaaagttatcttgacaaggttaagactaaaaaagcggaccatgacattgtgaaagatcgccgctttaccgtggataaaatgatgttccacgtcccgattgcgatgaactttaaggcgatcagtaaaccgaacttaaacaaaaaagtcattgatggcatcattgatgatcaggatctgaaaatcattggtattgatcgtggcgagcggaacttaatttacgtcacgatggttgacagaaaagggaatatcttatatcaggattctcttaacatcctcaatggctacgactatcgtaaagctctggatgtgcgcgaatatgacaacaaggaagcgcgtcgtaactggactaaagtggagggcattcgcaaaatgaaggaaggctatctgtcattagcggtctcgaaattagcggatatgattatcgaaaataacgccatcatcgttatggaggacctgaaccacggattcaaagcgggccgctcaaagattgaaaaacaagtttatcagaaatttgagagtatgctgattaacaaactgggctatatggtgttaaaagacaagtcaattgaccaatcaggtggcgcgctgcatggataccagctggcgaaccatgttaccaccttagcatcagttggaaagcagtgtggggttatcttttatataccggcagcgttcactagtaaaatagatccgaccactggtttcgccgatctctttgccctgagtaacgttaaaaacgtagcgagcatgcgtgaattcttttccaaaatgaaatctgtcatttatgataaagctgaaggcaaattcgcattcacctttgattacttggattacaacgtgaagagcgaatgtggtcgtacgctgtggaccgtttacaccgttggtgagcgcttcacctattcccgtgtgaaccgcgaatatgtacgtaaagtccccaccgatattatctatgatgccctccagaaagcaggcattagcgtcgaaggagacttaagggacagaattgccgaaagcgatggcgatacgctgaagtctattttttacgcattcaaatacgcgctagatatgcgcgttgagaatcgcgaggaagactacattcaatcacctgtgaaaaatgcctctggggaatttttttgttcaaaaaatgctggtaaaagcctcccacaagatagcgatgcaaacggtgcatataacattgccctgaaaggtattcttcaattacgcatgctgtctgagcagtacgaccccaacgcggaatctattagacttccgctgataaccaataaagcctggctgacattcatgcagtctggcatgaagacctggaaaaattaggaaatcatccttagcgaaagctaaggattttttttatctgaaatgtagggagaccctcaggttaaatattcactcaggaagttattactcaggaagcaaagaggattaca

SEQ ID NO: 66 - DNA, 4565 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatggatagtttgaaagatttcaccaatctgtaccctgtcagtaagacattgagatttgaattaaagcccgttggaaagactttagaaaatatcgagaaagcaggtattttgaaagaggatgagcatcgtgcagaaagttatcggagggtgaagaaaataattgatacttatcataaggtatttatcgattcttctcttgaaaatatggctaaaatgggtattgagaatgaaataaaagcaatgctccaaagtttctgcgaattgtataaaaaagatcatcgcactgagggtgaagacaaggcattagataaaattcgagcagtacttcgtggcctgattgttggggctttcactggtgtttgcggaagacgggaaaatacagtccaaaacgagaagtacgagagtttgttcaaagaaaagttgataaaagaaattttacctgattttgtgctctctactgaggctgaaagcttgcctttctctgttgaagaagctacgaggtcactgaaggagtttgatagctttacatcctactttgctggtttttacgagaatagaaagaatatatactcgacgaaacctcaatccactgccattgcttatcgtcttattcatgagaacttgccgaagttcattgataatattcttgtttttcagaagatcaaagagcctatagccaaagagctggaacatattcgtgcggacttttctgccggggggtacataaaaaaggatgagagattggaggatattttttcgttgaactattatatccacgtgttatctcaggctgggatcgaaaaatataacgcattgattgggaagattgtgacagaaggagatggagagatgaaagggctcaatgaacacatcaacctttacaaccaacaaagaggcagagaggatcggctccctctttttaggcctctttataaacagatattgagtgacagagagcaattatcatacttgcctgagagttttgaaaaagatgaggagctcctcagggctctaaaagagttctatgatcatatcgcagaagacattctcggacgtactcaacagttgatgacttctatttcagaatatgatttatctcggatatacgtaaggaacgatagccaattgactgatatatcaaaaaaaatgttgggagattggaatgctatctacatggctagagaacgagcatatgaccacgagcaggctcccaaaagaatcacggcgaaatacgagagggacaggattaaagctcttaaaggagaagagagtataagtctggcaaatcttaatagttgtattgcctttctggacaatgttagagattgccgtgtagatacttatctttccacactgggccagaaggaaggaccacatggtctatctaatctcgttgagaacgtttttgcctcataccatgaagcagagcaattgttgagctttccataccccgaagagaataatctgattcaggacaaggacaatgtggtgttaattaagaatcttctcgacaatatcagtgatctgcagaggttcttgaaacctctttggggtatgggagacgaacccgataaagatgaaagattttatggagagtataattatatccgaggagctctagatcaggtgatccctctgtacaataaggtaaggaactacctcactcggaagccttattcgaccagaaaagtaaaactcaattttgggaattctcaattgcttagtggttgggatagaaataaggaaaaggataatagctgtgtgattttgcgtaaggggcagaacttctatttggctattatgaacaataggcacaaaagaagtttcgaaaacaaggtgttgcccgagtataaggagggagaaccttacttcgaaaagatggattataaatttttgcctgatcctaataaaatgcttcctaaggtttttctttcgaaaaaaggaatagagatatacaaaccaagtccgaagcttttagaacaatatggacatggaactcacaaaaagggagatacctttagtatggatgatttgcacgaactgatcgatttcttcaaacactcaatcgaggctcatgaagattggaagcaattcggattcaaattttctgatacggctacttatgagaatgtatctagtttctatagagaagttgaggatcaggggtataagctctctttccgaaaagtttcggaatcttatgtctattcattaatagatcaaggcaagttgtatttatttcagatatacaacaaggacttttctccctgcagcaaagggacacctaatctgcataccttgtattggagaatgctttttgacgagcgcaatttggcagatgtcatatacaaactggatgggaaggctgaaatctttttccgagagaagagtttgaaaaatgatcatcccacgcatccggctggtaagcctatcaaaaagaaaagtcgacaaaaaaaaggagaggagagtctgtttgagtatgatttagtcaaggataggcactatacgatggataagttccagtttcatgtgcctattactatgaattttaaatgttctgcaggaagcaaagtcaatgatatggttaatgctcatattcgagaggcaaaggatatgcatgtcattggaattgatcgtggagaacgcaatctgctgtatatatgcgtgatagatagtcgagggacgattttggatcaaatttctctgaatacgattaacgatatagactatcatgatttattggagagtcgagacaaagaccgtcagcaggagcgccgaaactggcaaactatcgaagggatcaaggagctaaaacaaggctaccttagtcaggcggttcatcggatagccgaactgatggtggcttataaggctgtagttgctttggaggatttgaatatggggttcaaacgtgggcggcagaaagtagaaagttctgtttatcagcagtttgagaaacagctgatagataagctcaactatcttgtggacaagaagaaaaggcctgaagatattggaggattgttgagagcctatcaatttacggccccatttaagagttttaaggaaatgggaaagcaaaacggcttcttgttttatatcccggcttggaacacgagcaacatagatccgactactggatttgttaatttatttcatgcccagtatgaaaatgtagataaagcgaagagcttctttcaaaagtttgattcaattagttacaacccgaagaaagactggtttgagtttgcattcgattataaaaactttactaaaaaggctgaaggaagtcgttctatgtggatattatgcacacatggttcccgaataaagaattttagaaattcccagaagaatggtcaatgggattccgaagaattcgccttgacggaggcttttaagtctctttttgtgcgatatgagatagattataccgctgatttgaaaacagctattgtggacgaaaagcaaaaagacttcttcgtggatcttctgaagctattcaaattgacagtacagatgcgcaacagctggaaagagaaggatttggattatctaatctctcctgtagcaggggctgatggccgtttcttcgatacaagagagggaaataaaagtctgcctaaggatgcagatgccaatggagcttataatattgccctaaaaggactttgggctctacgccagattcggcaaacttcagaaggcggtaaactcaaattggcgatttccaataaggaatggctacagtttgtgcaagagagatcttacgagaaagactgagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 67 - DNA, 4574 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatgaacaacggcacaaataattttcagaacttcatcgggatctcaagtttgcagaaaacgctgcgcaatgctctgatccccacggaaaccacgcaacagttcatcgtcaagaacggaataattaaagaagatgagttacgtggcgagaaccgccagattctgaaagatatcatggatgactactaccgcggattcatctctgagactctgagttctattgatgacatagattggactagcctgttcgaaaaaatggaaattcagctgaaaaatggtgataataaagataccttaattaaggaacagacagagtatcggaaagcaatccataaaaaatttgcgaacgacgatcggtttaagaacatgtttagcgccaaactgattagtgacatattacctgaatttgtcatccacaacaataattattcggcatcagagaaagaggaaaaaacccaggtgataaaattgttttcgcgctttgcgactagctttaaagattacttcaagaaccgtgcaaattgcttttcagcggacgatatttcatcaagcagctgccatcgcatcgtcaacgacaatgcagagatattcttttcaaatgcgctggtctaccgccggatcgtaaaatcgctgagcaatgacgatatcaacaaaatttcgggcgatatgaaagattcattaaaagaaatgagtctggaagaaatatattcttacgagaagtatggggaatttattacccaggaaggcattagcttctataatgatatctgtgggaaagtgaattcttttatgaacctgtattgtcagaaaaataaagaaaacaaaaatttatacaaacttcagaaacttcacaaacagattctatgcattgcggacactagctatgaggtcccgtataaatttgaaagtgacgaggaagtgtaccaatcagttaacggcttccttgataacattagcagcaaacatatagtcgaaagattacgcaaaatcggcgataactataacggctacaacctggataaaatttatatcgtgtccaaattttacgagagcgttagccaaaaaacctaccgcgactgggaaacaattaataccgccctcgaaattcattacaataatatcttgccgggtaacggtaaaagtaaagccgacaaagtaaaaaaagcggttaagaatgatttacagaaatccatcaccgaaataaatgaactagtgtcaaactataagctgtgcagtgacgacaacatcaaagcggagacttatatacatgagattagccatatcttgaataactttgaagcacaggaattgaaatacaatccggaaattcacctagttgaatccgagctcaaagcgagtgagcttaaaaacgtgctggacgtgatcatgaatgcgtttcattggtgttcggtttttatgactgaggaacttgttgataaagacaacaatttttatgcggaactggaggagatttacgatgaaatttatccagtaattagtctgtacaacctggttcgtaactacgttacccagaaaccgtacagcacgaaaaagattaaattgaactttggaataccgacgttagcagacggttggtcaaagtccaaagagtattctaataacgctatcatactgatgcgcgacaatctgtattatctgggcatctttaatgcgaagaataaaccggacaagaagattatcgagggtaatacgtcagaaaataagggtgactacaaaaagatgatttataatttgctcccgggtcccaacaaaatgatcccgaaagttttcttgagcagcaagacgggggtggaaacgtataaaccgagcgcctatatcctagaggggtataaacagaataaacatatcaagtcttcaaaagactttgatatcactttctgtcatgatctgatcgactacttcaaaaactgtattgcaattcatcccgagtggaaaaacttcggttttgattttagcgacaccagtacttatgaagacatttccgggttttatcgtgaggtagagttacaaggttacaagattgattggacatacattagcgaaaaagacattgatctgctgcaggaaaaaggtcaactgtatctgttccagatatataacaaagatttttcgaaaaaatcaaccgggaatgacaaccttcacaccatgtacctgaaaaatcttttctcagaagaaaatcttaaggatatcgtcctgaaacttaacggcgaagcggaaatcttcttcaggaagagcagcataaagaacccaatcattcataaaaaaggctcgattttagtcaaccgtacctacgaagcagaagaaaaagaccagtttggcaacattcaaattgtgcgtaaaaatattccggaaaacatttatcaggagctgtacaaatacttcaacgataaaagcgacaaagagctgtctgatgaagcagccaaactgaagaatgtagtgggacaccacgaggcagcgacgaatatagtcaaggactatcgctacacgtatgataaatacttccttcatatgcctattacgatcaatttcaaagccaataaaacgggttttattaatgataggatcttacagtatatcgctaaagaaaaagacttacatgtgatcggcattgatcggggcgagcgtaacctgatctacgtgtccgtgattgatacttgtggtaatatagttgaacagaaaagctttaacattgtaaacggctacgactatcagataaaactgaaacaacaggagggcgctagacagattgcgcggaaagaatggaaagaaattggtaaaattaaagagatcaaagagggctacctgagcttagtaatccacgagatctctaaaatggtaatcaaatacaatgcaattatagcgatggaggatttgtcttatggttttaaaaaagggcgctttaaggtcgaacggcaagtttaccagaaatttgaaaccatgctcatcaataaactcaactatctggtatttaaagatatttcgattaccgagaatggcggtctcctgaaaggttatcagctgacatacattcctgataaacttaaaaacgtgggtcatcagtgcggctgcattttttatgtgcctgctgcatacacgagcaaaattgatccgaccaccggctttgtgaatatctttaaatttaaagacctgacagtggacgcaaaacgtgaattcattaaaaaatttgactcaattcgttatgacagtgaaaaaaatctgttctgctttacatttgactacaataactttattacgcaaaacacggtcatgagcaaatcatcgtggagtgtgtatacatacggcgtgcgcatcaaacgtcgctttgtgaacggccgcttctcaaacgaaagtgataccattgacataaccaaagatatggagaaaacgttggaaatgacggacattaactggcgcgatggccacgatcttcgtcaagacattatagattatgaaattgttcagcacatattcgaaattttccgtttaacagtgcaaatgcgtaactccttgtctgaactggaggaccgtgattacgatcgtctcatttcacctgtactgaacgaaaataacattttttatgacagcgcgaaagcgggggatgcacttcctaaggatgccgatgcaaatggtgcgtattgtattgcattaaaagggttatatgaaattaaacaaattaccgaaaattggaaagaagatggtaaattttcgcgcgataaactcaaaatcagcaataaagattggttcgactttatccagaataagcgctatctctaagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 68 - DNA, 4489 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataccaataaattcactaaccagtattctctctctaagaccctgcgctttgaactgattccgcaggggaaaaccttggagttcattcaagaaaaaggcctcttgtctcaggataaacagagggctgaatcttaccaagaaatgaagaaaactattgataagtttcataaatatttcattgatttagccttgtctaacgccaaattaactcacttggaaacgtatctggagttatacaacaaatctgccgaaactaagaaagaacagaaatttaaagacgatttgaaaaaagtacaggacaatctgcgtaaagaaattgtcaaatccttcagtgacggcgatgctaaaagcatttttgccattctggacaaaaaagagttgattactgtggaattagaaaagtggtttgaaaacaatgagcagaaagacatctacttcgatgagaaattcaaaactttcaccacctattttacaggatttcatcaaaaccggaagaacatgtactcagtagaaccgaactccacggccattgcgtatcgtttgatccatgagaatctgcctaaatttctggagaatgcgaaagcctttgaaaagattaagcaggtcgaatcgctgcaagtgaattttcgtgaactcatgggcgaatttggtgacgaaggtctaatcttcgttaacgaactggaagaaatgtttcagattaattactacaatgacgtgctatcgcagaacggtatcacaatctacaatagtattatctcagggttcacaaaaaacgatataaaatacaaaggcctgaacgagtatatcaataactacaaccaaacaaaggacaaaaaggataggcttccgaaactgaagcagttatacaaacagattttatctgacagaatctccctgagctttctgccggatgctttcactgatgggaagcaggttctgaaagcgattttcgatttttataagattaacttactgagctacacgattgaaggtcaagaagaatctcaaaacttactgctcttgatccgtcaaaccattgaaaatctatcatcgttcgatacgcagaaaatctacctcaaaaacgatactcacctgactacgatctctcagcaggttttcggggattttagtgtattttcaacagctctgaactactggtatgaaaccaaagtcaatccgaaattcgagacggaatattctaaggccaacgaaaaaaaacgtgagattcttgataaagctaaagccgtatttactaaacaggattacttttctattgctttcctgcaggaagttttatcggagtatatcctgaccctggatcatacatctgatatcgttaaaaaacacagcagcaattgcatcgctgactatttcaaaaaccactttgtcgccaaaaaagaaaacgaaacagacaagactttcgatttcattgctaacatcaccgcaaaataccagtgtattcagggtatcttggaaaacgccgaccaatacgaagacgaactgaaacaagatcagaagctgatcgataatttaaaattcttcttagatgcaatcctggagctgctgcacttcatcaaaccgcttcatttaaagagcgagtccattaccgaaaaggacaccgccttctatgacgtttttgaaaattattatgaagccctctccttgctgactccgctgtataatatggtacgcaattacgtaacccagaaaccatattctaccgaaaaaattaaactgaactttgaaaacgcacagctgctcaacggttgggacgcgaataaagaaggtgactacctcaccaccatcctgaaaaaagatggtaactattttctggcaattatggataagaaacataataaagcattccagaaatttcctgaagggaaagaaaattacgaaaagatggtgtacaaactcttacctggagttaacaaaatgttgccgaaagtattttttagtaataagaacatcgcgtactttaacccgtccaaagaactgctggaaaattataaaaaggagacgcataagaaaggggatacctttaacctggaacattgccataccttaatagacttcttcaaggattccctgaataaacacgaggattggaaatatttcgattttcagtttagtgagaccaagtcataccaggatcttagcggcttttatcgcgaagtagaacaccaaggctataaaattaacttcaaaaacatcgacagcgaatacatcgacggtttagttaacgagggcaaactgtttctgttccagatctattcaaaggattttagcccgttctctaaaggcaaaccaaatatgcatacgttgtactggaaagcactgtttgaagagcaaaacctgcagaatgtgatttataaactgaacggccaagctgagatttttttccgtaaagcctcgattaaaccgaaaaatatcatccttcataagaagaaaataaagatcgctaaaaaacacttcatagataaaaaaaccaaaacctccgaaatagtgcctgttcaaacaattaagaacttgaatatgtactaccagggcaagatatcggaaaaggagttgactcaagacgatcttcgctatatcgataacttttcgatttttaacgaaaaaaacaagacgatcgacatcatcaaagataaacgcttcactgtagataagttccagtttcatgtgccgattactatgaacttcaaagctaccgggggtagctatatcaaccaaacggtgttggaatacctgcagaataacccggaagtcaaaatcattgggctggaccgcggagaacgtcaccttgtgtacttgaccttaatcgatcagcaaggcaacatcttaaaacaagaatcgctgaataccattacggattcaaagattagcaccccgtatcataagctgctcgataacaaggagaatgagcgcgacctggcccgtaaaaactggggcacggtggaaaacattaaggagttaaaggagggttatatttcccaggtagtgcataagatcgccactctcatgctcgaggaaaatgcgatcgttgtcatggaagacttaaacttcggatttaaacgtgggcgatttaaagtagagaaacaaatctaccagaagttagaaaaaatgctgattgacaaattaaattacttggtcctaaaagacaaacagccgcaagaattgggtggattatacaacgccctccaacttaccaataaattcgaaagttttcagaaaatgggtaaacagtcaggctttcttttttatgttcctgcgtggaacacatccaaaatcgaccctacaaccggcttcgtcaattacttctatactaaatatgaaaacgtcgacaaagcaaaagcattctttgaaaagttcgaagcaatacgttttaacgctgagaaaaaatatttcgagttcgaagtcaagaaatactcagactttaaccccaaagctgagggcacacagcaagcgtggacaatctgcacctacggcgagcgcatcgaaacgaagcgtcaaaaagatcagaataacaaatttgtttcaacacctatcaacctgaccgagaagattgaagacttcttaggtaaaaatcagattgtttatggcgacggtaactgtataaaatctcaaatagcctcaaaggatgataaagcatttttcgaaacattattatattggttcaaaatgacactgcagatgcgcaatagtgagacgcgtacagatattgattatcttatcagcccggtcatgaacgacaacggtactttttacaactccagagactatgaaaaacttgagaatccaactctccccaaagatgctgatgcgaacggtgcttatcacatcgcgaaaaaaggtctgatgctgctgaacaaaatcgaccaagccgatctgactaagaaagttgacctaagcatttcaaatcgggactggttacagtttgttcaaaagaacaaatgagaaatcatccttagcgaaagctaaggattttttttatctgaaatgtagggagaccctcaggttaaatattcactcaggaagttattactcaggaagcaaagaggattaca

SEQ ID NO: 69 - DNA, 4805 bp, Artificial Sequence
  Description of Artificial Sequence: Synthetic polynucleotide
aaaattccatgcaaaatgctccggtttcatgtcatcaaaatgatgacgtaattaagcattgataattgagatccctctccctgacaggatgattacataaataatagtgacaaaaataaattatttatttatccagaaaatgaattggaaaatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatataccatggaacaggaatattatctgggcttggacatgggcaccggttccgtcggctgggctgttactgacagtgaatatcacgttctaagaaagcatggtaaggcattgtggggtgtaagacttttcgaatctgcttccactgctgaagagcgtagaatgtttagaacgagtcgacgtaggctagacaggcgcaattggagaatcgaaattttacaagaaatttttgcggaagagatatctaagaaagacccaggctttttcctgagaatgaaggaatctaagtattaccctgaggataaaagagatataaatggtaactgtcccgaattgccttacgcattatttgtggacgatgattttaccgataaggattaccataaaaagttcccaactatctaccatttacgcaaaatgttaatgaatacagaggaaaccccagacataagactagtttatctggcaatacaccatatgatgaaacatagaggccatttcttactttccggggatatcaacgaaatcaaagagtttggtaccacatttagtaagttactggaaaacataaagaatgaagaattggattggaacttagaactcggaaaagaagaatacgcggttgtcgaatctatcctgaaggataatatgctgaataggtcgaccaaaaaaactaggctgatcaaagcactgaaagccaaatctatctgcgaaaaagctgttttaaatttacttgctggtggcactgttaagttatcagacatttttggtttggaagaattgaacgaaaccgagcgtccaaaaattagtttcgctgataatggctacgatgattacattggtgaggtggaaaacgagttgggcgaacaattttatattatagagacagctaaggcagtctatgactgggctgttttagtagaaatccttggtaaatacacatctatctccgaagcgaaagttgctacttacgaaaagcacaagtccgatctccagtttttgaagaaaattgtcaggaaatatctgactaaggaagaatataaagatattttcgttagtacctctgacaaactgaaaaattactccgcttacatcgggatgaccaagattaatggcaaaaaagttgatctgcaaagcaaaaggtgttcgaaggaagaattttatgatttcattaaaaagaatgtcttaaaaaaattagaaggtcagccagaatacgaatatttgaaagaagaactggaaagagagacattcttaccaaaacaagtcaacagagataatggggtaattccatatcaaattcacctctacgaattaaaaaaaattttaggcaatttacgcgataaaattgaccttatcaaagaaaatgaggataagctggttcaactctttgaattcagaataccctattatgtgggcccactgaacaagattgatgacggcaaagaaggtaaattcacatgggccgtccgcaaatccaatgaaaaaatttacccatggaactttgaaaatgtagtagatattgaagcgtctgcggagaaatttattcgaagaatgactaataaatgcacttacttgatgggagaggatgttctgcctaaagacagcttattatacagcaagtacatggttctaaacgaacttaacaacgttaagttggacggtgagaaattaagtgtagaattgaaacaaagattgtatactgacgtcttctgcaagtacagaaaagtgacagttaaaaaaattaagaattacttgaagtgcgaaggtataatttctggaaacgtagagattactggtattgatggtgatttcaaagcatccctaacagcttaccacgatttcaaggaaatcctgacaggaactgaactcgcaaaaaaagataaagaaaacattattactaatattgttcttttcggtgatgacaagaaattgttgaagaaaagactgaatagactttacccccagattactcccaatcaacttaagaaaatttgtgctttgtcttacacaggatggggtcgtttttcaaaaaagttcttagaagagattaccgcacctgatccagaaacaggcgaagtatggaatataattaccgccttatgggaatcgaacaataatcttatgcaacttctgagcaatgaatatcgtttcatggaagaagttgagacttacaacatgggcaaacagacgaagactttatcctatgaaactgtggaaaatatgtatgtatcaccttctgtcaagagacaaatttggcaaaccttaaaaattgtcaaagaattagaaaaggtaatgaaggagtctcctaaacgtgtgtttattgaaatggctagagaaaaacaagagtcaaaaagaaccgagtcaagaaagaagcagttaatcgatttatataaggcttgtaaaaacgaagagaaagattgggttaaagaattgggggaccaagaggaacaaaaactacggtcggataagttgtatttatactatacgcaaaagggacgatgtatgtattccggcgaggtaatagaattgaaggatttatgggacaatacaaaatatgacatagaccatatatatccccaatcaaaaacgatggacgatagcttgaacaatagagtactcgtgaaaaaaaaatataatgcgaccaaatctgataagtatcctctgaatgaaaatatcagacatgaaagaaaggggttctggaagtccttgttagatggtgggtttataagcaaagaaaagtacgagcgtctaataagaaacacggagttatcgccagaagaactcgctggttttattgagaggcaaatcgtggaaacgagacaatctaccaaagccgttgctgagatcctaaagcaagttttcccagagtcggagattgtctatgtcaaagctggcacagtgagcaggtttaggaaagacttcgaactattaaaggtaagagaagtgaacgatttacatcacgcaaaggacgcttacctaaatatcgttgtaggtaactcatattatgttaaatttaccaagaacgcctcttggtttataaaggagaacccaggtagaacatataacctgaaaaagatgttcacctctggttggaatattgagagaaacggagaagtcgcatgggaagttggtaagaaagggactatagtgacagtaaagcaaattatgaacaaaaataatatcctcgttacaaggcaggttcatgaagcaaagggcggcctttttgaccaacaaattatgaagaaagggaaaggtcaaattgcaataaaagaaaccgatgagagactagcgtcaatagaaaagtatggtggctataataaagctgcgggtgcatactttatgcttgttgaatcaaaagacaagaaaggtaagactattagaactatagaatttatacccctgtaccttaaaaacaaaattgaatcggatgagtcaatcgcgttaaattttctagagaaaggaaggggtttaaaagaaccaaagatcctgttaaaaaagattaagattgacaccttgttcgatgtagatggatttaaaatgtggttatctggcagaacaggcgatagacttttgtttaagtgcgctaatcaattaattttggatgagaaaatcattgtcacaatgaaaaaaatagttaagtttattcagagaagacaagaaaacagggagttgaaattatctgataaagatggtatcgacaatgaagttttaatggaaatctacaatacattcgttgataaacttgaaaataccgtatatcgaatcaggttaagtgaacaagccaaaacattaattgataaacaaaaagaatttgaaaggctatcactggaagacaaatcctccaccctatttgaaattttgcatatattccagtgccaatcttcagcagctaatttaaaaatgattggcggacctgggaaagccggcatcctagtgatgaacaataatatctccaagtgtaacaaaatatcaattattaaccaatctccgacaggtatttttgaaaatgaaatagacttgcttaagatataagaaatcatccttagcgaaagctaaggattttttttatctgaaatttattatatcgcgttgattattgatgctgtttttagttttaacggcaattaatatatgtgttattaattgaatgaattttatcattcataataagtatgtgtaggatcaagctcaggttaaatattcactcaggaagttattactcaggaagcaaagaggattacagaattatctcataacaagtgttaagggatgttatttcc

SEQ ID NO: 70 - DNA, 4363 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccattctttcgactctttcaccaacctgtactctctgtctaaaaccctgaaattcgaaatgcgtccggttggtaacacccagaaaatgctggacaacgcgggtgttttcgaaaaagacaaactgatccagaaaaaatacggtaaaaccaaaccgtacttcgaccgtctgcaccgtgaattcatcgaagaagcgctgaccggtgttgaactgatcggtctggacgaaaacttccgtaccctggttgactggcagaaagacaaaaaaaacaacgttgcgatgaaagcgtacgaaaactctctgcagcgtctgcgtaccgaaatcggtaaaatcttcaacctgaaagcggaagactgggttaaaaacaaatacccgatcctgggtctgaaaaacaaaaacaccgacatcctgttcgaagaagcggttttcggtatcctgaaagcgcgttacggtgaagaaaaagacaccttcatcgaagttgaagaaatcgacaaaaccggtaaatctaaaatcaaccagatctctatcttcgactcttggaaaggtttcaccggttacttcaaaaaattcttcgaaacccgtaaaaacttctacaaaaacgacggtacctctaccgcgatcgcgacccgtatcatcgaccagaacctgaaacgtttcatcgacaacctgtctatcgttgaatctgttcgtcagaaagttgacctggcggaaaccgaaaaatctttctctatctctctgtctcagttcttctctatcgacttctacaacaaatgcctgctgcaggacggtatcgactactacaacaaaatcatcggtggtgaaaccctgaaaaacggtgaaaaactgatcggtctgaacgaactgatcaaccagtaccgtcagaacaacaaagaccagaaaatcccgttcttcaaactgctggacaaacagatcctgtctgaaaaaatcctgttcctggacgaaatcaaaaacgacaccgaactgatcgaagcgctgtctcagttcgcgaaaaccgcggaagaaaaaaccaaaatcgttaaaaaactgttcgcggacttcgttgaaaacaactctaaatacgacctggcgcagatctacatctctcaggaagcgttcaacaccatctctaacaaatggacctctgaaaccgaaaccttcgcgaaatacctgttcgaagcgatgaaatctggtaaactggcgaaatacgaaaaaaaagacaactcttacaaattcccggacttcatcgcgctgtctcagatgaaatctgcgctgctgtctatctctctggaaggtcacttctggaaagaaaaatactacaaaatctctaaattccaggaaaaaaccaactgggaacagttcctggcgatcttcctgtacgaattcaactctctgttctctgacaaaatcaacaccaaagacggtgaaaccaaacaggttggttactacctgttcgcgaaagacctgcacaacctgatcctgtctgaacagatcgacatcccgaaagactctaaagttaccatcaaagacttcgcggactctgttctgaccatctaccagatggcgaaatacttcgcggttgaaaaaaaacgtgcgtggctggcggaatacgaactggactctttctacacccagccggacaccggttacctgcagttctacgacaacgcgtacgaagacatcgttcaggtttacaacaaactgcgtaactacctgaccaaaaaaccgtactctgaagaaaaatggaaactgaacttcgaaaactctaccctggcgaacggttgggacaaaaacaaagaatctgacaactctgcggttatcctgcagaaaggtggtaaatactacctgggtctgatcaccaaaggtcacaacaaaatcttcgacgaccgtttccaggaaaaattcatcgttggtatcgaaggtggtaaatacgaaaaaatcgtttacaaattcttcccggaccaggcgaaaatgttcccgaaagtttgcttctctgcgaaaggtctggaattcttccgtccgtctgaagaaatcctgcgtatctacaacaacgcggaattcaaaaaaggtgaaacctactctatcgactctatgcagaaactgatcgacttctacaaagactgcctgaccaaatacgaaggttgggcgtgctacaccttccgtcacctgaaaccgaccgaagaataccagaacaacatcggtgaattcttccgtgacgttgcggaagacggttaccgtatcgacttccagggtatctctgaccagtacatccacgaaaaaaacgaaaaaggtgaactgcacctgttcgaaatccacaacaaagactggaacctggacaaagcgcgtgacggtaaatctaaaaccacccagaaaaacctgcacaccctgtacttcgaatctctgttctctaacgacaacgttgttcagaacttcccgatcaaactgaacggtcaggcggaaatcttctaccgtccgaaaaccgaaaaagacaaactggaatctaaaaaagacaaaaaaggtaacaaagttatcgaccacaaacgttactctgaaaacaaaatcttcttccacgttccgctgaccctgaaccgtaccaaaaacgactcttaccgtttcaacgcgcagatcaacaacttcctggcgaacaacaaagacatcaacatcatcggtgttgaccgtggtgaaaaacacctggtttactactctgttatcacccaggcgtctgacatcctggaatctggttctctgaacgaactgaacggtgttaactacgcggaaaaactgggtaaaaaagcggaaaaccgtgaacaggcgcgtcgtgactggcaggacgttcagggtatcaaagacctgaaaaaaggttacatctctcaggttgttcgtaaactggcggacctggcgatcaaacacaacgcgatcatcatcctggaagacctgaacatgcgtttcaaacaggttcgtggtggtatcgaaaaatctatctaccagcagctggaaaaagcgctgatcgacaaactgtctttcctggttgacaaaggtgaaaaaaacccggaacaggcgggtcacctgctgaaagcgtaccagctgtctgcgccgttcgaaaccttccagaaaatgggtaaacagaccggtatcatcttctacacccaggcgtcttacacctctaaatctgacccggttaccggttggcgtccgcacctgtacctgaaatacttctctgcgaaaaaagcgaaagacgacatcgcgaaattcaccaaaatcgaattcgttaacgaccgtttcgaactgacctacgacatcaaagacttccagcaggcgaaagaatacccgaacaaaaccgtttggaaagtttgctctaacgttgaacgtttccgttgggacaaaaacctgaaccagaacaaaggtggttacacccactacaccaacatcaccgaaaacatccaggaactgttcaccaaatacggtatcgacatcaccaaagacctgctgacccagatctctaccatcgacgaaaaacagaacacctctttcttccgtgacttcatcttctacttcaacctgatctgccagatccgtaacaccgacgactctgaaatcgcgaaaaaaaacggtaaagacgacttcatcctgtctccggttgaaccgttcttcgactctcgtaaagacaacggtaacaaactgccggaaaacggtgacgacaacggtgcgtacaacatcgcgcgtaaaggtatcgttatcctgaacaaaatctctcagtactctgaaaaaaacgaaaactgcgaaaaaatgaaatggggtgacctgtacgtttctaacatcgactgggacaacttcgttgaaatcatccttagcgaaagctaaggattttttttatctgaaatgtagggagaccctcaggttaaatattcactcaggaagttattactcaggaagcaaagaggattaca

SEQ ID NO: 71 - DNA, 4375 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataacaaattcgaaaacttcaccggtctgtacccgatctctaaaaccctgcgtttcgaactgatcccgcagggtaaaaccctggaatacatcgaaaaatctgaaatcctggaaaacgacaactaccgtgcggaaaaatacgaagaagttaaagacatcatcgacggttaccacaaatggttcatcaacgaaaccctgcacgacctgcacatcaactggtctgaactgaaagttgcgctggaaaacaaccgtatcgaaaaatctgacgcgtctaaaaaagaactgcagcgtgttcagaaaatcaaacgtgaagaaatctacaacgcgttcatcgaacacgaagcgttccagtacctgttcaaagaaaacctgctgtctgacctgctgccgatccagatcgaacagtctgaagacctggacgcggaaaaaaaaaaacaggcggttgaaaccttcaaccgtttctctacctacttcaccggtttccacgaaaaccgtaaaaacatctactctaaagaaggtatctctacctctgttacctaccgtatcgttcacgacaacttcccgaaattcctggaaaacatgaaagttttcgaaatcctgcgtaacgaatgcccggaagttatctctgacaccgcgaacgaactggcgccgttcatcgacggtgttcgtatcgaagacatcttcctgatcgacttcttcaactctaccttctctcagaacggtatcgactactacaaccgtatcctgggtggtgttaccaccgaaaccggtgaaaaataccgtggtatcaacgaattcaccaacctgtaccgtcagcagcacccggaattcggtaaatctaaaaaagcgaccaaaatggttgttctgttcaaacagatcctgtctgaccgtgacaccctgtctttcatcccggaaatgttcggtaacgacaaacaggttcagaactctatccagctgttctacaaccgtgaaatctctcagttcgaaaacgaaggtgttaaaaccgacgtttgcaccgcgctggcgaccctgacctctaaaatcgcggaattcgacaccgaaaaaatctacatccagcagccggaactgccgaacgtttctcagcgtctgttcggttcttggaacgaactgaacgcgtgcctgttcaaatacgcggaactgaaattcggtaccgcggaaaaagttgcgaaccgtaaaaaaatcgacaaatggctgaaatctgacctgttctctttcaccgaactgaacaaagcgctggaattctctggtaaagacgaacgtatcgaaaactacttctctgaaaccggtatcttcgcgcagctggttaaaaccggtttcgacgaagcgcagtctatcctggaaaccgaatacacctctgaagttcacctgaaagaccagcagaccgacatcgaaaaaatcaaaaccttcctggacgcgctgcagaacctgatgcacctgctgaaatctctgtgcgtttctgaagaagcggaccgtgacgcggcgttctacaacgaattcgacatgctgtacaaccagctgaaactggttgttccgctgtacaacaaagttcgtaactacatcacccagaaactgttccgttctgacaaaatcaaaatctacttcgaaaacaaaggtcagttcctgggtggttgggttgactctcagaccgaaaactctgacaacggtacccaggcgggtggttacatcttccgtaaagaaaacgttatcaacgaatacgactactacctgggtatctgctctgacccgaaactgttccgtcgtaccaccatcgtttctgaaaacgaccgttcttctttcgaacgtctggactactaccagctgaaaaccgcgtctgtttacggtaactcttactgcggtaaacacccgtacaccgaagacaaaaacgaactggttaactctatcgaccgtttcgttcacctgtctggtaacaacatcctgatcgaaaaaatcgcgaaagacaaagttaaatctaacccgaccaccaacaccccgtctggttacctgaacttcatccaccgtgaagcgccgaacacctacgaatgcctgctgcaggacgaaaacttcgtttctctgaaccagcgtgttgtttctgcgctgaaagcgaccctggcgaccctggttcgtgttccgaaagcgctggtttacgcgaaaaaagactaccacctgttctctgaaatcatcaacgacatcgacgaactgtcttacgaaaaagcgttctcttacttcccggtttctcagaccgaattcgaaaactcttctaaccgtaccatcaaaccgctgctgctgttcaaaatctctaacaaagacctgtctttcgcggaaaacttcgaaaaaggtaaccgtcagaaaatcggtaaaaaaaacctgcacaccctgtacttcgaagcgctgatgaaaggtaaccaggacaccatcgacatcggtaccggtatggttttccaccgtgttaaatctctgaactacaacgaaaaaaccctgaaatacggtcaccactctacccagctgaacgaaaaattctcttacccgatcatcaaagacaaacgtttcgcgtctgacaaattcctgttccacctgtctaccgaaatcaactacaaagaaaaacgtaaaccgctgaacaactctatcatcgaattcctgaccaacaacccggacatcaacatcatcggtctggaccgtggtgaacgtcacctgatctacctgaccctgatcaaccagaaaggtgaaatcctgcgtcagaaaaccttcaacatcgttggtaacaccaactaccacgaaaaactgaaccagcgtgaaaaagaacgtgacaacgcgcgtaaatcttgggcgaccatcggtaaaatcaaagaactgaaagaaggtttcctgtctctggttatccacgaaatcgcgaaaatcatggttgaaaacaacgcgatcgttgttctggaagacctgaacttcggtttcaaacgtggtcgtttcaaagttgaaaaacagatctaccagaaattcgaaaaaatgctgatcgacaaactgaactacctggttttcaaagacaaaaaagcgaacgaagcgggtggtgttctgaaaggttaccagctggcggaaaaattcgaatctttccagaaaatgggtaaacagtctggtttcctgttctacgttccggcggcgtacacctctaaaatcgacccgaccaccggtttcgttaacatgctgaacctgaactacaccaacatgaaagacgcgcagaccctgctgtctggtatggacaaaatctctttcaacgcggacgcgaactacttcgaattcgaactggactacgaaaaattcaaaaccaaccagaccgaccacaccaacaaatggaccatctgcaccgttggtgaaaaacgtttcacctacaactctgcgaccaaagaaaccaccaccgttaacgttaccgaagacctgaaaaaactgctggacaaattcgaagttaaatactctaacggtgacaacatcaaagacgaaatctgccgtcagaccgacgcgaaattcttcgaaatcatcctgtggctgctgaaactgaccatgcagatgcgtaactctaacaccaaaaccgaagaagacttcatcctgtctccggttaaaaactctaacggtgaattcttccgttctaacgacgacgcgaacggtatctggccggcggacgcggacgcgaacggtgcgtaccacatcgcgctgaaaggtctgtacctggttaaagaatgcttcaacaaaaacgaaaaatctctgaaaatcgaacacaaaaactggttcaaattcgcgcagacccgtttcaacggttctctgaccaaaaacggttaagaaatcatccttagcgaaagctaaggattttttttatctgaaatgtagggagaccctcaggttaaatattcactcaggaagttattactcaggaagcaaagaggattaca

SEQ ID NO: 72 - DNA, 4455 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatacccagttcgaaggtttcaccaacctgtaccaggtttctaaaaccctgcgtttcgaactgatcccgcagggtaaaaccctgaaacacatccaggaacagggtttcatcgaagaagacaaagcgcgtaacgaccactacaaagaactgaaaccgatcatcgaccgtatctacaaaacctacgcggaccagtgcctgcagctggttcagctggactgggaaaacctgtctgcggcgatcgactcttaccgtaaagaaaaaaccgaagaaacccgtaacgcgctgatcgaagaacaggcgacctaccgtaacgcgatccacgactacttcatcggtcgtaccgacaacctgaccgacgcgatcaacaaacgtcacgcggaaatctacaaaggtctgttcaaagcggaactgttcaacggtaaagttctgaaacagctgggtaccgttaccaccaccgaacacgaaaacgcgctgctgcgttctttcgacaaattcaccacctacttctctggtttctacgaaaaccgtaaaaacgttttctctgcggaagacatctctaccgcgatcccgcaccgtatcgttcaggacaacttcccgaaattcaaagaaaactgccacatcttcacccgtctgatcaccgcggttccgtctctgcgtgaacacttcgaaaacgttaaaaaagcgatcggtatcttcgtttctacctctatcgaagaagttttctctttcccgttctacaaccagctgctgacccagacccagatcgacctgtacaaccagctgctgggtggtatctctcgtgaagcgggtaccgaaaaaatcaaaggtctgaacgaagttctgaacctggcgatccagaaaaacgacgaaaccgcgcacatcatcgcgtctctgccgcaccgtttcatcccgctgttcaaacagatcctgtctgaccgtaacaccctgtctttcatcctggaagaattcaaatctgacgaagaagttatccagtctttctgcaaatacaaaaccctgctgcgtaacgaaaacgttctggaaaccgcggaagcgctgttcaacgaactgaactctatcgacctgacccacatcttcatctctcacaaaaaactggaaaccatctcttctgcgctgtgcgaccactgggacaccctgcgtaacgcgctgtacgaacgtcgtatctctgaactgaccggtaaaatcaccaaatctgcgaaagaaaaagttcagcgttctctgaaacacgaagacatcaacctgcaggaaatcatctctgcggcgggtaaagaactgtctgaagcgttcaaacagaaaacctctgaaatcctgtctcacgcgcacgcggcgctggaccagccgctgccgaccaccctgaaaaaacaggaagaaaaagaaatcctgaaatctcagctggactctctgctgggtctgtaccacctgctggactggttcgcggttgacgaatctaacgaagttgacccggaattctctgcgcgtctgaccggtatcaaactggaaatggaaccgtctctgtctttctacaacaaagcgcgtaactacgcgaccaaaaaaccgtactctgttgaaaaattcaaactgaacttccagatgccgaccctggcgtctggttgggacgttaacaaagaaaaaaacaacggtgcgatcctgttcgttaaaaacggtctgtactacctgggtatcatgccgaaacagaaaggtcgttacaaagcgctgtctttcgaaccgaccgaaaaaacctctgaaggtttcgacaaaatgtactacgactacttcccggacgcggcgaaaatgatcccgaaatgctctacccagctgaaagcggttaccgcgcacttccagacccacaccaccccgatcctgctgtctaacaacttcatcgaaccgctggaaatcaccaaagaaatctacgacctgaacaacccggaaaaagaaccgaaaaaattccagaccgcgtacgcgaaaaaaaccggtgaccagaaaggttaccgtgaagcgctgtgcaaatggatcgacttcacccgtgacttcctgtctaaatacaccaaaaccacctctatcgacctgtcttctctgcgtccgtcttctcagtacaaagacctgggtgaatactacgcggaactgaacccgctgctgtaccacatctctttccagcgtatcgcggaaaaagaaatcatggacgcggttgaaaccggtaaactgtacctgttccagatctacaacaaagacttcgcgaaaggtcaccacggtaaaccgaacctgcacaccctgtactggaccggtctgttctctccggaaaacctggcgaaaacctctatcaaactgaacggtcaggcggaactgttctaccgtccgaaatctcgtatgaaacgtatggcgcaccgtctgggtgaaaaaatgctgaacaaaaaactgaaagaccagaaaaccccgatcccggacaccctgtaccaggaactgtacgactacgttaaccaccgtctgtctcacgacctgtctgacgaagcgcgtgcgctgctgccgaacgttatcaccaaagaagtttctcacgaaatcatcaaagaccgtcgtttcacctctgacaaattcttcttccacgttccgatcaccctgaactaccaggcggcgaactctccgtctaaattcaaccagcgtgttaacgcgtacctgaaagaacacccggaaaccccgatcatcggtatcgaccgtggtgaacgtaacctgatctacatcaccgttatcgactctaccggtaaaatcctggaacagcgttctctgaacaccatccagcagttcgactaccagaaaaaactggacaaccgtgaaaaagaacgtgttgcggcgcgtcaggcgtggtctgttgttggtaccatcaaagacctgaaacagggttacctgtctcaggttatccacgaaatcgttgacctgatgatccactaccaggcggttgttgttctggaaaacctgaacttcggtttcaaatctaaacgtaccggtatcgcggaaaaagcggtttaccagcagttcgaaaaaatgctgatcgacaaactgaactgcctggttctgaaagactacccggcggaaaaagttggtggtgttctgaacccgtaccagctgaccgaccagttcacctctttcgcgaaaatgggtacccagtctggtttcctgttctacgttccggcgccgtacacctctaaaatcgacccgctgaccggtttcgttgacccgttcgtttggaaaaccatcaaaaaccacgaatctcgtaaacacttcctggaaggtttcgacttcctgcactacgacgttaaaaccggtgacttcatcctgcacttcaaaatgaaccgtaacctgtctttccagcgtggtctgccgggtttcatgccggcgtgggacatcgttttcgaaaaaaacgaaacccagttcgacgcgaaaggtaccccgttcatcgcgggtaaacgtatcgttccggttatcgaaaaccaccgtttcaccggtcgttaccgtgacctgtacccggcgaacgaactgatcgcgctgctggaagaaaaaggtatcgttttccgtgacggttctaacatcctgccgaaactgctggaaaacgacgactctcacgcgatcgacaccatggttgcgctgatccgttctgttctgcagatgcgtaactctaacgcggcgaccggtgaagactacatcaactctccggttcgtgacctgaacggtgtttgcttcgactctcgtttccagaacccggaatggccgatggacgcggacgcgaacggtgcgtaccacatcgcgctgaaaggtcagctgctgctgaaccacctgaaagaatctaaagacctgaaactgcagaacggtatctctaaccaggactggctggcgtacatccaggaactgcgtaactagaaatcatccttagcgaaagctaaggattttttttatctgaaatgtagggagaccctcaggttaaatattcactcaggaagttattactcaggaagcaaagaggattaca

SEQ ID NO: 73 - DNA, 3922 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcggttaaatctatcaaagttaaactgcgtctggacgacatgccggaaatccgtgcgggtctgtggaaactgcacaaagaagttaacgcgggtgttcgttactacaccgaatggctgtctctgctgcgtcaggaaaacctgtaccgtcgttctccgaacggtgacggtgaacaggaatgcgacaaaaccgcggaagaatgcaaagcggaactgctggaacgtctgcgtgcgcgtcaggttgaaaacggtcaccgtggtccggcgggttctgacgacgaactgctgcagctggcgcgtcagctgtacgaactgctggttccgcaggcgatcggtgcgaaaggtgacgcgcagcagatcgcgcgtaaattcctgtctccgctggcggacaaagacgcggttggtggtctgggtatcgcgaaagcgggtaacaaaccgcgttgggttcgtatgcgtgaagcgggtgaaccgggttgggaagaagaaaaagaaaaagcggaaacccgtaaatctgcggaccgtaccgcggacgttctgcgtgcgctggcggacttcggtctgaaaccgctgatgcgtgtttacaccgactctgaaatgtcttctgttgaatggaaaccgctgcgtaaaggtcaggcggttcgtacctgggaccgtgacatgttccagcaggcgatcgaacgtatgatgtcttgggaatcttggaaccagcgtgttggtcaggaatacgcgaaactggttgaacagaaaaaccgtttcgaacagaaaaacttcgttggtcaggaacacctggttcacctggttaaccagctgcagcaggacatgaaagaagcgtctccgggtctggaatctaaagaacagaccgcgcactacgttaccggtcgtgcgctgcgtggttctgacaaagttttcgaaaaatggggtaaactggcgccggacgcgccgttcgacctgtacgacgcggaaatcaaaaacgttcagcgtcgtaacacccgtcgtttcggttctcacgacctgttcgcgaaactggcggaaccggaataccaggcgctgtggcgtgaagacgcgtctttcctgacccgttacgcggtttacaactctatcctgcgtaaactgaaccacgcgaaaatgttcgcgaccttcaccctgccggacgcgaccgcgcacccgatctggacccgtttcgacaaactgggtggtaacctgcaccagtacaccttcctgttcaacgaattcggtgaacgtcgtcacgcgatccgtttccacaaactgctgaaagttgaaaacggtgttgcgcgtgaagttgacgacgttaccgttccgatctctatgtctgaacagctggacaacctgctgccgcgtgacccgaacgaaccgatcgcgctgtacttccgtgactacggtgcggaacagcacttcaccggtgaattcggtggtgcgaaaatccagtgccgtcgtgaccagctggcgcacatgcaccgtcgtcgtggtgcgcgtgacgtttacctgaacgtttctgttcgtgttcagtctcagtctgaagcgcgtggtgaacgtcgtccgccgtacgcggcggttttccgtctggttggtgacaaccaccgtgcgttcgttcacttcgacaaactgtctgactacctggcggaacacccggacgacggtaaactgggttctgaaggtctgctgtctggtctgcgtgttatgtctgttgacctgggtctgcgtacctctgcgtctatctctgttttccgtgttgcgcgtaaagacgaactgaaaccgaactctaaaggtcgtgttccgttcttcttcccgatcaaaggtaacgacaacctggttgcggttcacgaacgttctcagctgctgaaactgccgggtgaaaccgaatctaaagacctgcgtgcgatccgtgaagaacgtcagcgtaccctgcgtcagctgcgtacccagctggcgtacctgcgtctgctggttcgttgcggttctgaagacgttggtcgtcgtgaacgttcttgggcgaaactgatcgaacagccggttgacgcggcgaaccacatgaccccggactggcgtgaagcgttcgaaaacgaactgcagaaactgaaatctctgcacggtatctgctctgacaaagaatggatggacgcggtttacgaatctgttcgtcgtgtttggcgtcacatgggtaaacaggttcgtgactggcgtaaagacgttcgttctggtgaacgtccgaaaatccgtggttacgcgaaagacgttgttggtggtaactctatcgaacagatcgaatacctggaacgtcagtacaaattcctgaaatcttggtctttcttcggtaaagtttctggtcaggttatccgtgcggaaaaaggttctcgtttcgcgatcaccctgcgtgaacacatcgaccacgcgaaagaagaccgtctgaaaaaactggcggaccgtatcatcatggaagcgctgggttacgtttacgcgctggacgaacgtggtaaaggtaaatgggttgcgaaatacccgccgtgccagctgatcctgctggaagaactgtctgaataccagttcaacaacgaccgtccgccgtctgaaaacaaccagctgatgcagtggtctcaccgtggtgttttccaggaactgatcaaccaggcgcaggttcacgacctgctggttggtaccatgtacgcggcgttctcttctcgtttcgacgcgcgtaccggtgcgccgggtatccgttgccgtcgtgttccggcgcgttgcacccaggaacacaacccggaaccgttcccgtggtggctgaacaaattcgttgttgaacacaccctggacgcgtgcccgctgcgtgcggacgacctgatcccgaccggtgaaggtgaaatcttcgtttctccgttctctgcggaagaaggtgacttccaccagatccacgcggacctgaacgcggcgcagaacctgcagcagcgtctgtggtctgacttcgacatctctcagatccgtctgcgttgcgactggggtgaagttgacggtgaactggttctgatcccgcgtctgaccggtaaacgtaccgcggactcttactctaacaaagttttctacaccaacaccggtgttacctactacgaacgtgaacgtggtaaaaaacgtcgtaaagttttcgcgcaggaaaaactgtctgaagaagaagcggaactgctggttgaagcggacgaagcgcgtgaaaaatctgttgttctgatgcgtgacccgtctggtatcatcaaccgtggtaactggacccgtcagaaagaattctggtctatggttaaccagcgtatcgaaggttacctggttaaacagatccgttctcgtgttccgctgcaggactctgcgtgcgaaaacaccggtgacatctaagaaatcatccttagcgaaagctaaggattttttttatctgaaatgtagggagaccctcaggttaaatattcactcaggaagttattactcaggaagcaaagaggattaca

SEQ ID NO: 74 - DNA, 3859 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcgacccgttctttcatcctgaaaatcgaaccgaacgaagaagttaaaaaaggtctgtggaaaacccacgaagttctgaaccacggtatcgcgtactacatgaacatcctgaaactgatccgtcaggaagcgatctacgaacaccacgaacaggacccgaaaaacccgaaaaaagtttctaaagcggaaatccaggcggaactgtgggacttcgttctgaaaatgcagaaatgcaactctttcacccacgaagttgacaaagacgttgttttcaacatcctgcgtgaactgtacgaagaactggttccgtcttctgttgaaaaaaaaggtgaagcgaaccagctgtctaacaaattcctgtacccgctggttgacccgaactctcagtctggtaaaggtaccgcgtcttctggtcgtaaaccgcgttggtacaacctgaaaatcgcgggtgacccgtcttgggaagaagaaaaaaaaaaatgggaagaagacaaaaaaaaagacccgctggcgaaaatcctgggtaaactggcggaatacggtctgatcccgctgttcatcccgttcaccgactctaacgaaccgatcgttaaagaaatcaaatggatggaaaaatctcgtaaccagtctgttcgtcgtctggacaaagacatgttcatccaggcgctggaacgtttcctgtcttgggaatcttggaacctgaaagttaaagaagaatacgaaaaagttgaaaaagaacacaaaaccctggaagaacgtatcaaagaagacatccaggcgttcaaatctctggaacagtacgaaaaagaacgtcaggaacagctgctgcgtgacaccctgaacaccaacgaataccgtctgtctaaacgtggtctgcgtggttggcgtgaaatcatccagaaatggctgaaaatggacgaaaacgaaccgtctgaaaaatacctggaagttttcaaagactaccagcgtaaacacccgcgtgaagcgggtgactactctgtttacgaattcctgtctaaaaaagaaaaccacttcatctggcgtaaccacccggaatacccgtacctgtacgcgaccttctgcgaaatcgacaaaaaaaaaaaagacgcgaaacagcaggcgaccttcaccctggcggacccgatcaaccacccgctgtgggttcgtttcgaagaacgttctggttctaacctgaacaaataccgtatcctgaccgaacagctgcacaccgaaaaactgaaaaaaaaactgaccgttcagctggaccgtctgatctacccgaccgaatctggtggttgggaagaaaaaggtaaagttgacatcgttctgctgccgtctcgtcagttctacaaccagatcttcctggacatcgaagaaaaaggtaaacacgcgttcacctacaaagacgaatctatcaaattcccgctgaaaggtaccctgggtggtgcgcgtgttcagttcgaccgtgaccacctgcgtcgttacccgcacaaagttgaatctggtaacgttggtcgtatctacttcaacatgaccgttaacatcgaaccgaccgaatctccggtttctaaatctctgaaaatccaccgtgacgacttcccgaaattcgttaacttcaaaccgaaagaactgaccgaatggatcaaagactctaaaggtaaaaaactgaaatctggtatcgaatctctggaaatcggtctgcgtgttatgtctatcgacctgggtcagcgtcaggcggcggcggcgtctatcttcgaagttgttgaccagaaaccggacatcgaaggtaaactgttcttcccgatcaaaggtaccgaactgtacgcggttcaccgtgcgtctttcaacatcaaactgccgggtgaaaccctggttaaatctcgtgaagttctgcgtaaagcgcgtgaagacaacctgaaactgatgaaccagaaactgaacttcctgcgtaacgttctgcacttccagcagttcgaagacatcaccgaacgtgaaaaacgtgttaccaaatggatctctcgtcaggaaaactctgacgttccgctggtttaccaggacgaactgatccagatccgtgaactgatgtacaaaccgtacaaagactgggttgcgttcctgaaacagctgcacaaacgtctggaagttgaaatcggtaaagaagttaaacactggcgtaaatctctgtctgacggtcgtaaaggtctgtacggtatctctctgaaaaacatcgacgaaatcgaccgtacccgtaaattcctgctgcgttggtctctgcgtccgaccgaaccgggtgaagttcgtcgtctggaaccgggtcagcgtttcgcgatcgaccagctgaaccacctgaacgcgctgaaagaagaccgtctgaaaaaaatggcgaacaccatcatcatgcacgcgctgggttactgctacgacgttcgtaaaaaaaaatggcaggcgaaaaacccggcgtgccagatcatcctgttcgaagacctgtctaactacaacccgtacgaagaacgttctcgtttcgaaaactctaaactgatgaaatggtctcgtcgtgaaatcccgcgtcaggttgcgctgcagggtgaaatctacggtctgcaggttggtgaagttggtgcgcagttctcttctcgtttccacgcgaaaaccggttctccgggtatccgttgctctgttgttaccaaagaaaaactgcaggacaaccgtttcttcaaaaacctgcagcgtgaaggtcgtctgaccctggacaaaatcgcggttctgaaagaaggtgacctgtacccggacaaaggtggtgaaaaattcatctctctgtctaaagaccgtaaactggttaccacccacgcggacatcaacgcggcgcagaacctgcagaaacgtttctggacccgtacccacggtttctacaaagtttactgcaaagcgtaccaggttgacggtcagaccgtttacatcccggaatctaaagaccagaaacagaaaatcatcgaagaattcggtgaaggttacttcatcctgaaagacggtgtttacgaatggggtaacgcgggtaaactgaaaatcaaaaaaggttcttctaaacagtcttcttctgaactggttgactctgacatcctgaaagactctttcgacctggcgtctgaactgaaaggtgaaaaactgatgctgtaccgtgacccgtctggtaacgttttcccgtctgacaaatggatggcggcgggtgttttcttcggtaaactggaacgtatcctgatctctaaactgaccaaccagtactctatctctaccatcgaagacgactcttctaaacagtctatgtaagaaatcatccttagcgaaagctaaggattttttttatctgaaatgtagggagaccctcaggttaaatattcactcaggaagttattactcaggaagcaaagaggattaca

SEQ ID NO: 75 - DNA, 3982 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatccgacccgtaccatcaacctgaaactggttctgggtaaaaacccggaaaacgcgaccctgcgtcgtgcgctgttctctacccaccgtctggttaaccaggcgaccaaacgtatcgaagaattcctgctgctgtgccgtggtgaagcgtaccgtaccgttgacaacgaaggtaaagaagcggaaatcccgcgtcacgcggttcaggaagaagcgctggcgttcgcgaaagcggcgcagcgtcacaacggttgcatctctacctacgaagaccaggaaatcctggacgttctgcgtcagctgtacgaacgtctggttccgtctgttaacgaaaacaacgaagcgggtgacgcgcaggcggcgaacgcgtgggtttctccgctgatgtctgcggaatctgaaggtggtctgtctgtttacgacaaagttctggacccgccgccggtttggatgaaactgaaagaagaaaaagcgccgggttgggaagcggcgtctcagatctggatccagtctgacgaaggtcagtctctgctgaacaaaccgggttctccgccgcgttggatccgtaaactgcgttctggtcagccgtggcaggacgacttcgtttctgaccagaaaaaaaaacaggacgaactgaccaaaggtaacgcgccgctgatcaaacagctgaaagaaatgggtctgctgccgctggttaacccgttcttccgtcacctgctggacccggaaggtaaaggtgtttctccgtgggaccgtctggcggttcgtgcggcggttgcgcacttcatctcttgggaatcttggaaccaccgtacccgtgcggaatacaactctctgaaactgcgtcgtgacgaattcgaagcggcgtctgacgaattcaaagacgacttcaccctgctgcgtcagtacgaagcgaaacgtcactctaccctgaaatctatcgcgctggcggacgactctaacccgtaccgtatcggtgttcgttctctgcgtgcgtggaaccgtgttcgtgaagaatggatcgacaaaggtgcgaccgaagaacagcgtgttaccatcctgtctaaactgcagacccagctgcgtggtaaattcggtgacccggacctgttcaactggctggcgcaggaccgtcacgttcacctgtggtctccgcgtgactctgttaccccgctggttcgtatcaacgcggttgacaaagttctgcgtcgtcgtaaaccgtacgcgctgatgaccttcgcgcacccgcgtttccacccgcgttggatcctgtacgaagcgccgggtggttctaacctgcgtcagtacgcgctggactgcaccgaaaacgcgctgcacatcaccctgccgctgctggttgacgacgcgcacggtacctggatcgaaaaaaaaatccgtgttccgctggcgccgtctggtcagatccaggacctgaccctggaaaaactggaaaaaaaaaaaaaccgtctgtactaccgttctggtttccagcagttcgcgggtctggcgggtggtgcggaagttctgttccaccgtccgtacatggaacacgacgaacgttctgaagaatctctgctggaacgtccgggtgcggtttggttcaaactgaccctggacgttgcgacccaggcgccgccgaactggctggacggtaaaggtcgtgttcgtaccccgccggaagttcaccacttcaaaaccgcgctgtctaacaaatctaaacacacccgtaccctgcagccgggtctgcgtgttctgtctgttgacctgggtatgcgtaccttcgcgtcttgctctgttttcgaactgatcgaaggtaaaccggaaaccggtcgtgcgttcccggttgcggacgaacgttctatggactctccgaacaaactgtgggcgaaacacgaacgttctttcaaactgaccctgccgggtgaaaccccgtctcgtaaagaagaagaagaacgttctatcgcgcgtgcggaaatctacgcgctgaaacgtgacatccagcgtctgaaatctctgctgcgtctgggtgaagaagacaacgacaaccgtcgtgacgcgctgctggaacagttcttcaaaggttggggtgaagaagacgttgttccgggtcaggcgttcccgcgttctctgttccagggtctgggtgcggcgccgttccgttctaccccggaactgtggcgtcagcactgccagacctactacgacaaagcggaagcgtgcctggcgaaacacatctctgactggcgtaaacgtacccgtccgcgtccgacctctcgtgaaatgtggtacaaaacccgttcttaccacggtggtaaatctatctggatgctggaatacctggacgcggttcgtaaactgctgctgtcttggtctctgcgtggtcgtacctacggtgcgatcaaccgtcaggacaccgcgcgtttcggttctctggcgtctcgtctgctgcaccacatcaactctctgaaagaagaccgtatcaaaaccggtgcggactctatcgttcaggcggcgcgtggttacatcccgctgccgcacggtaaaggttgggaacagcgttacgaaccgtgccagctgatcctgttcgaagacctggcgcgttaccgtttccgtgttgaccgtccgcgtcgtgaaaactctcagctgatgcagtggaaccaccgtgcgatcgttgcggaaaccaccatgcaggcggaactgtacggtcagatcgttgaaaacaccgcggcgggtttctcttctcgtttccacgcggcgaccggtgcgccgggtgttcgttgccgtttcctgctggaacgtgacttcgacaacgacctgccgaaaccgtacctgctgcgtgaactgtcttggatgctgggtaacaccaaagttgaatctgaagaagaaaaactgcgtctgctgtctgaaaaaatccgtccgggttctctggttccgtgggacggtggtgaacagttcgcgaccctgcacccgaaacgtcagaccctgtgcgttatccacgcggacatgaacgcggcgcagaacctgcagcgtcgtttcttcggtcgttgcggtgaagcgttccgtctggtttgccagccgcacggtgacgacgttctgcgtctggcgtctaccccgggtgcgcgtctgctgggtgcgctgcagcagctggaaaacggtcagggtgcgttcgaactggttcgtgacatgggttctacctctcagatgaaccgtttcgttatgaaatctctgggtaaaaaaaaaatcaaaccgctgcaggacaacaacggtgacgacgaactggaagacgttctgtctgttctgccggaagaagacgacaccggtcgtatcaccgttttccgtgactcttctggtatcttcttcccgtgcaacgtttggatcccggcgaaacagttctggccggcggttcgtgcgatgatctggaaagttatggcgtctcactctctgggttaagaaatcatccttagcgaaagctaaggattttttttatctgaaatgtagggagaccctcaggttaaatattcactcaggaagttattactcaggaagcaaagaggattaca

SEQ ID NO: 76 - DNA, 4291 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataccaaactgcgtcaccgtcagaaaaaactgacccacgactgggcgggttctaaaaaacgtgaagttctgggttctaacggtaaactgcagaacccgctgctgatgccggttaaaaaaggtcaggttaccgaattccgtaaagcgttctctgcgtacgcgcgtgcgaccaaaggtgaaatgaccgacggtcgtaaaaacatgttcacccactctttcgaaccgttcaaaaccaaaccgtctctgcaccagtgcgaactggcggacaaagcgtaccagtctctgcactcttacctgccgggttctctggcgcacttcctgctgtctgcgcacgcgctgggtttccgtatcttctctaaatctggtgaagcgaccgcgttccaggcgtcttctaaaatcgaagcgtacgaatctaaactggcgtctgaactggcgtgcgttgacctgtctatccagaacctgaccatctctaccctgttcaacgcgctgaccacctctgttcgtggtaaaggtgaagaaacctctgcggacccgctgatcgcgcgtttctacaccctgctgaccggtaaaccgctgtctcgtgacacccagggtccggaacgtgacctggcggaagttatctctcgtaaaatcgcgtcttctttcggtacctggaaagaaatgaccgcgaacccgctgcagtctctgcagttcttcgaagaagaactgcacgcgctggacgcgaacgtttctctgtctccggcgttcgacgttctgatcaaaatgaacgacctgcagggtgacctgaaaaaccgtaccatcgttttcgacccggacgcgccggttttcgaatacaacgcggaagacccggcggacatcatcatcaaactgaccgcgcgttacgcgaaagaagcggttatcaaaaaccagaacgttggtaactacgttaaaaacgcgatcaccaccaccaacgcgaacggtctgggttggctgctgaacaaaggtctgtctctgctgccggtttctaccgacgacgaactgctggaattcatcggtgttgaacgttctcacccgtcttgccacgcgctgatcgaactgatcgcgcagctggaagcgccggaactgttcgaaaaaaacgttttctctgacacccgttctgaagttcagggtatgatcgactctgcggtttctaaccacatcgcgcgtctgtcttcttctcgtaactctctgtctatggactctgaagaactggaacgtctgatcaaatctttccagatccacaccccgcactgctctctgttcatcggtgcgcagtctctgtctcagcagctggaatctctgccggaagcgctgcagtctggtgttaactctgcggacatcctgctgggttctacccagtacatgctgaccaactctctggttgaagaatctatcgcgacctaccagcgtaccctgaaccgtatcaactacctgtctggtgttgcgggtcagatcaacggtgcgatcaaacgtaaagcgatcgacggtgaaaaaatccacctgccggcggcgtggtctgaactgatctctctgccgttcatcggtcagccggttatcgacgttgaatctgacctggcgcacctgaaaaaccagtaccagaccctgtctaacgaattcgacaccctgatctctgcgctgcagaaaaacttcgacctgaacttcaacaaagcgctgctgaaccgtacccagcacttcgaagcgatgtgccgttctaccaaaaaaaacgcgctgtctaaaccggaaatcgtttcttaccgtgacctgctggcgcgtctgacctcttgcctgtaccgtggttctctggttctgcgtcgtgcgggtatcgaagttctgaaaaaacacaaaatcttcgaatctaactctgaactgcgtgaacacgttcacgaacgtaaacacttcgttttcgtttctccgctggaccgtaaagcgaaaaaactgctgcgtctgaccgactctcgtccggacctgctgcacgttatcgacgaaatcctgcagcacgacaacctggaaaacaaagaccgtgaatctctgtggctggttcgttctggttacctgctggcgggtctgccggaccagctgtcttcttctttcatcaacctgccgatcatcacccagaaaggtgaccgtcgtctgatcgacctgatccagtacgaccagatcaaccgtgacgcgttcgttatgctggttacctctgcgttcaaatctaacctgtctggtctgcagtaccgtgcgaacaaacagtctttcgttgttacccgtaccctgtctccgtacctgggttctaaactggtttacgttccgaaagacaaagactggctggttccgtctcagatgttcgaaggtcgtttcgcggacatcctgcagtctgactacatggtttggaaagacgcgggtcgtctgtgcgttatcgacaccgcgaaacacctgtctaacatcaaaaaatctgttttctcttctgaagaagttctggcgttcctgcgtgaactgccgcaccgtaccttcatccagaccgaagttcgtggtctgggtgttaacgttgacggtatcgcgttcaacaacggtgacatcccgtctctgaaaaccttctctaactgcgttcaggttaaagtttctcgtaccaacacctctctggttcagaccctgaaccgttggttcgaaggtggtaaagtttctccgccgtctatccagttcgaacgtgcgtactacaaaaaagacgaccagatccacgaagacgcggcgaaacgtaaaatccgtttccagatgccggcgaccgaactggttcacgcgtctgacgacgcgggttggaccccgtcttacctgctgggtatcgacccgggtgaatacggtatgggtctgtctctggtttctatcaacaacggtgaagttctggactctggtttcatccacatcaactctctgatcaacttcgcgtctaaaaaatctaaccaccagaccaaagttgttccgcgtcagcagtacaaatctccgtacgcgaactacctggaacagtctaaagactctgcggcgggtgacatcgcgcacatcctggaccgtctgatctacaaactgaacgcgctgccggttttcgaagcgctgtctggtaactctcagtctgcggcggaccaggtttggaccaaagttctgtctttctacacctggggtgacaacgacgcgcagaactctatccgtaaacagcactggttcggtgcgtctcactgggacatcaaaggtatgctgcgtcagccgccgaccgaaaaaaaaccgaaaccgtacatcgcgttcccgggttctcaggtttcttcttacggtaactctcagcgttgctcttgctgcggtcgtaacccgatcgaacagctgcgtgaaatggcgaaagacacctctatcaaagaactgaaaatccgtaactctgaaatccagctgttcgacggtaccatcaaactgttcaacccggacccgtctaccgttatcgaacgtcgtcgtcacaacctgggtccgtctcgtatcccggttgcggaccgtaccttcaaaaacatctctccgtcttctctggaattcaaagaactgatcaccatcgtttctcgttctatccgtcactctccggaattcatcgcgaaaaaacgtggtatcggttctgaatacttctgcgcgtactctgactgcaactcttctctgaactctgaagcgaacgcggcggcgaacgttgcgcagaaattccagaaacagctgttcttcgaactgtaagaaatcatccttagcgaaagctaaggattttttttatctgaaatgtagggagaccctcaggttaaatattcactcaggaagttattactcaggaagcaaagaggattaca

SEQ ID NO: 77 - DNA, 4396 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataaacgtatcctgaactctctgaaagttgcggcgctgcgtctgctgttccgtggtaaaggttctgaactggttaaaaccgttaaatacccgctggtttctccggttcagggtgcggttgaagaactggcggaagcgatccgtcacgacaacctgcacctgttcggtcagaaagaaatcgttgacctgatggaaaaagacgaaggtacccaggtttactctgttgttgacttctggctggacaccctgcgtctgggtatgttcttctctccgtctgcgaacgcgctgaaaatcaccctgggtaaattcaactctgaccaggtttctccgttccgtaaagttctggaacagtctccgttcttcctggcgggtcgtctgaaagttgaaccggcggaacgtatcctgtctgttgaaatccgtaaaatcggtaaacgtgaaaaccgtgttgaaaactacgcggcggacgttgaaacctgcttcatcggtcagctgtcttctgacgaaaaacagtctatccagaaactggcgaacgacatctgggactctaaagaccacgaagaacagcgtatgctgaaagcggacttcttcgcgatcccgctgatcaaagacccgaaagcggttaccgaagaagacccggaaaacgaaaccgcgggtaaacagaaaccgctggaactgtgcgtttgcctggttccggaactgtacacccgtggtttcggttctatcgcggacttcctggttcagcgtctgaccctgctgcgtgacaaaatgtctaccgacaccgcggaagactgcctggaatacgttggtatcgaagaagaaaaaggtaacggtatgaactctctgctgggtaccttcctgaaaaacctgcagggtgacggtttcgaacagatcttccagttcatgctgggttcttacgttggttggcagggtaaagaagacgttctgcgtgaacgtctggacctgctggcggaaaaagttaaacgtctgccgaaaccgaaattcgcgggtgaatggtctggtcaccgtatgttcctgcacggtcagctgaaatcttggtcttctaacttcttccgtctgttcaacgaaacccgtgaactgctggaatctatcaaatctgacatccagcacgcgaccatgctgatctcttacgttgaagaaaaaggtggttaccacccgcagctgctgtctcagtaccgtaaactgatggaacagctgccggcgctgcgtaccaaagttctggacccggaaatcgaaatgacccacatgtctgaagcggttcgttcttacatcatgatccacaaatctgttgcgggtttcctgccggacctgctggaatctctggaccgtgacaaagaccgtgaattcctgctgtctatcttcccgcgtatcccgaaaatcgacaaaaaaaccaaagaaatcgttgcgtgggaactgccgggtgaaccggaagaaggttacctgttcaccgcgaacaacctgttccgtaacttcctggaaaacccgaaacacgttccgcgtttcatggcggaacgtatcccggaagactggacccgtctgcgttctgcgccggtttggttcgacggtatggttaaacagtggcagaaagttgttaaccagctggttgaatctccgggtgcgctgtaccagttcaacgaatctttcctgcgtcagcgtctgcaggcgatgctgaccgtttacaaacgtgacctgcagaccgaaaaattcctgaaactgctggcggacgtttgccgtccgctggttgacttcttcggtctgggtggtaacgacatcatcttcaaatcttgccaggacccgcgtaaacagtggcagaccgttatcccgctgtctgttccggcggacgtttacaccgcgtgcgaaggtctggcgatccgtctgcgtgaaaccctgggtttcgaatggaaaaacctgaaaggtcacgaacgtgaagacttcctgcgtctgcaccagctgctgggtaacctgctgttctggatccgtgacgcgaaactggttgttaaactggaagactggatgaacaacccgtgcgttcaggaatacgttgaagcgcgtaaagcgatcgacctgccgctggaaatcttcggtttcgaagttccgatcttcctgaacggttacctgttctctgaactgcgtcagctggaactgctgctgcgtcgtaaatctgttatgacctcttactctgttaaaaccaccggttctccgaaccgtctgttccagctggtttacctgccgctgaacccgtctgacccggaaaaaaaaaactctaacaacttccaggaacgtctggacaccccgaccggtctgtctcgtcgtttcctggacctgaccctggacgcgttcgcgggtaaactgctgaccgacccggttacccaggaactgaaaaccatggcgggtttctacgaccacctgttcggtttcaaactgccgtgcaaactggcggcgatgtctaaccacccgggttcttcttctaaaatggttgttctggcgaaaccgaaaaaaggtgttgcgtctaacatcggtttcgaaccgatcccggacccggcgcacccggttttccgtgttcgttcttcttggccggaactgaaatacctggaaggtctgctgtacctgccggaagacaccccgctgaccatcgaactggcggaaacctctgtttcttgccagtctgtttcttctgttgcgttcgacctgaaaaacctgaccaccatcctgggtcgtgttggtgaattccgtgttaccgcggaccagccgttcaaactgaccccgatcatcccggaaaaagaagaatctttcatcggtaaaacctacctgggtctggacgcgggtgaacgttctggtgttggtttcgcgatcgttaccgttgacggtgacggttacgaagttcagcgtctgggtgttcacgaagacacccagctgatggcgctgcagcaggttgcgtctaaatctctgaaagaaccggttttccagccgctgcgtaaaggtaccttccgtcagcaggaacgtatccgtaaatctctgcgtggttgctactggaacttctaccacgcgctgatgatcaaataccgtgcgaaagttgttcacgaagaatctgttggttcttctggtctggttggtcagtggctgcgtgcgttccagaaagacctgaaaaaagcggacgttctgccgaaaaaaggtggtaaaaacggtgttgacaaaaaaaaacgtgaatcttctgcgcaggacaccctgtggggtggtgcgttctctaaaaaagaagaacagcagatcgcgttcgaagttcaggcggcgggttcttctcagttctgcctgaaatgcggttggtggttccagctgggtatgcgtgaagttaaccgtgttcaggaatctggtgttgttctggactggaaccgttctatcgttaccttcctgatcgaatcttctggtgaaaaagtttacggtttctctccgcagcagctggaaaaaggtttccgtccggacatcgaaaccttcaaaaaaatggttcgtgacttcatgcgtccgccgatgttcgaccgtaaaggtcgtccggcggcggcgtacgaacgtttcgttctgggtcgtcgtcaccgtcgttaccgtttcgacaaagttttcgaagaacgtttcggtcgttctgcgctgttcatctgcccgcgtgttggttgcggtaacttcgaccactcttctgaacagtctgcggttgttctggcgctgatcggttacatcgcggacaaagaaggtatgtctggtaaaaaactggtttacgttcgtctggcggaactgatggcggaatggaaactgaaaaaactggaacgttctcgtgttgaagaacagtcttctgcgcagtaagaaatcatccttagcgaaagctaaggattttttttatctgaaatgtagggagaccctcaggttaaatattcactcaggaagttattactcaggaagcaaagaggattaca

SEQ ID NO: 78 - DNA, 4111 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgcggaatctaaacagatgcagtgccgtaaatgcggtgcgtctatgaaatacgaagttatcggtctgggtaaaaaatcttgccgttacatgtgcccggactgcggtaaccacacctctgcgcgtaaaatccagaacaaaaaaaaacgtgacaaaaaatacggttctgcgtctaaagcgcagtctcagcgtatcgcggttgcgggtgcgctgtacccggacaaaaaagttcagaccatcaaaacctacaaatacccggcggacctgaacggtgaagttcacgactctggtgttgcggaaaaaatcgcgcaggcgatccaggaagacgaaatcggtctgctgggtccgtcttctgaatacgcgtgctggatcgcgtctcagaaacagtctgaaccgtactctgttgttgacttctggttcgacgcggtttgcgcgggtggtgttttcgcgtactctggtgcgcgtctgctgtctaccgttctgcagctgtctggtgaagaatctgttctgcgtgcggcgctggcgtcttctccgttcgttgacgacatcaacctggcgcaggcggaaaaattcctggcggtttctcgtcgtaccggtcaggacaaactgggtaaacgtatcggtgaatgcttcgcggaaggtcgtctggaagcgctgggtatcaaagaccgtatgcgtgaattcgttcaggcgatcgacgttgcgcagaccgcgggtcagcgtttcgcggcgaaactgaaaatcttcggtatctctcagatgccggaagcgaaacagtggaacaacgactctggtctgaccgtttgcatcctgccggactactacgttccggaagaaaaccgtgcggaccagctggttgttctgctgcgtcgtctgcgtgaaatcgcgtactgcatgggtatcgaagacgaagcgggtttcgaacacctgggtatcgacccgggtgcgctgtctaacttctctaacggtaacccgaaacgtggtttcctgggtcgtctgctgaacaacgacatcatcgcgctggcgaacaacatgtctgcgatgaccccgtactgggaaggtcgtaaaggtgaactgatcgaacgtctggcgtggctgaaacaccgtgcggaaggtctgtacctgaaagaaccgcacttcggtaactcttgggcggaccaccgttctcgtatcttctctcgtatcgcgggttggctgtctggttgcgcgggtaaactgaaaatcgcgaaagaccagatctctggtgttcgtaccgacctgttcctgctgaaacgtctgctggacgcggttccgcagtctgcgccgtctccggacttcatcgcgtctatctctgcgctggaccgtttcctggaagcggcggaatcttctcaggacccggcggaacaggttcgtgcgctgtacgcgttccacctgaacgcgccggcggttcgttctatcgcgaacaaagcggttcagcgttctgactctcaggaatggctgatcaaagaactggacgcggttgaccacctggaattcaacaaagcgttcccgttcttctctgacaccggtaaaaaaaaaaaaaaaggtgcgaactctaacggtgcgccgtctgaagaagaatacaccgaaaccgaatctatccagcagccggaagacgcggaacaggaagttaacggtcaggaaggtaacggtgcgtctaaaaaccagaaaaaattccagcgtatcccgcgtttcttcggtgaaggttctcgttctgaataccgtatcctgaccgaagcgccgcagtacttcgacatgttctgcaacaacatgcgtgcgatcttcatgcagctggaatctcagccgcgtaaagcgccgcgtgacttcaaatgcttcctgcagaaccgtctgcagaaactgtacaaacagaccttcctgaacgcgcgttctaacaaatgccgtgcgctgctggaatctgttctgatctcttggggtgaattctacacctacggtgcgaacgaaaaaaaattccgtctgcgtcacgaagcgtctgaacgttcttctgacccggactacgttgttcagcaggcgctggaaatcgcgcgtcgtctgttcctgttcggtttcgaatggcgtgactgctctgcgggtgaacgtgttgacctggttgaaatccacaaaaaagcgatctctttcctgctggcgatcacccaggcggaagtttctgttggttcttacaactggctgggtaactctaccgtttctcgttacctgtctgttgcgggtaccgacaccctgtacggtacccagctggaagaattcctgaacgcgaccgttctgtctcagatgcgtggtctggcgatccgtctgtcttctcaggaactgaaagacggtttcgacgttcagctggaatcttcttgccaggacaacctgcagcacctgctggtttaccgtgcgtctcgtgacctggcggcgtgcaaacgtgcgacctgcccggcggaactggacccgaaaatcctggttctgccggttggtgcgttcatcgcgtctgttatgaaaatgatcgaacgtggtgacgaaccgctggcgggtgcgtacctgcgtcaccgtccgcactctttcggttggcagatccgtgttcgtggtgttgcggaagttggtatggaccagggtaccgcgctggcgttccagaaaccgaccgaatctgaaccgttcaaaatcaaaccgttctctgcgcagtacggtccggttctgtggctgaactcttcttcttactctcagtctcagtacctggacggtttcctgtctcagccgaaaaactggtctatgcgtgttctgccgcaggcgggttctgttcgtgttgaacagcgtgttgcgctgatctggaacctgcaggcgggtaaaatgcgtctggaacgttctggtgcgcgtgcgttcttcatgccggttccgttctctttccgtccgtctggttctggtgacgaagcggttctggcgccgaaccgttacctgggtctgttcccgcactctggtggtatcgaatacgcggttgttgacgttctggactctgcgggtttcaaaatcctggaacgtggtaccatcgcggttaacggtttctctcagaaacgtggtgaacgtcaggaagaagcgcaccgtgaaaaacagcgtcgtggtatctctgacatcggtcgtaaaaaaccggttcaggcggaagttgacgcggcgaacgaactgcaccgtaaatacaccgacgttgcgacccgtctgggttgccgtatcgttgttcagtgggcgccgcagccgaaaccgggtaccgcgccgaccgcgcagaccgtttacgcgcgtgcggttcgtaccgaagcgccgcgttctggtaaccaggaagaccacgcgcgtatgaaatcttcttggggttacacctggggtacctactgggaaaaacgtaaaccggaagacatcctgggtatctctacccaggtttactggaccggtggtatcggtgaatcttgcccggcggttgcggttgcgctgctgggtcacatccgtgcgacctctacccagaccgaatgggaaaaagaagaagttgttttcggtcgtctgaaaaaattcttcccgtcttaagaaatcatccttagcgaaagctaaggattttttttatctgaaatgtagggagaccctcaggttaaatattcactcaggaagttattactcaggaagcaaagaggattaca

SEQ ID NO: 79 - DNA, 3493 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccatgaaaaacgtatcaacaaaatccgtaaaaaactgtctgcggacaacgcgaccaaaccggtttctcgttctggtccgatgaaaaccctgctggttcgtgttatgaccgacgacctgaaaaaacgtctggaaaaacgtcgtaaaaaaccggaagttatgccgcaggttatctctaacaacgcggcgaacaacctgcgtatgctgctggacgactacaccaaaatgaaagaagcgatcctgcaggtttactggcaggaattcaaagacgaccacgttggtctgatgtgcaaattcgcgcagccggcgtctaaaaaaatcgaccagaacaaactgaaaccggaaatggacgaaaaaggtaacctgaccaccgcgggtttcgcgtgctctcagtgcggtcagccgctgttcgtttacaaactggaacaggtttctgaaaaaggtaaagcgtacaccaactacttcggtcgttgcaacgttgcggaacacgaaaaactgatcctgctggcgcagctgaaaccggaaaaagactctgacgaagcggttacctactctctgggtaaattcggtcagcgtgcgctggacttctactctatccacgttaccaaagaatctacccacccggttaaaccgctggcgcagatcgcgggtaaccgttacgcgtctggtccggttggtaaagcgctgtctgacgcgtgcatgggtaccatcgcgtctttcctgtctaaataccaggacatcatcatcgaacaccagaaagttgttaaaggtaaccagaaacgtctggaatctctgcgtgaactggcgggtaaagaaaacctggaatacccgtctgttaccctgccgccgcagccgcacaccaaagaaggtgttgacgcgtacaacgaagttatcgcgcgtgttcgtatgtgggttaacctgaacctgtggcagaaactgaaactgtctcgtgacgacgcgaaaccgctgctgcgtctgaaaggtttcccgtctttcccggttgttgaacgtcgtgaaaacgaagttgactggtggaacaccatcaacgaagttaaaaaactgatcgacgcgaaacgtgacatgggtcgtgttttctggtctggtgttaccgcggaaaaacgtaacaccatcctggaaggttacaactacctgccgaacgaaaacgaccacaaaaaacgtgaaggttctctggaaaacccgaaaaaaccggcgaaacgtcagttcggtgacctgctgctgtacctggaaaaaaaatacgcgggtgactggggtaaagttttcgacgaagcgtgggaacgtatcgacaaaaaaatcgcgggtctgacctctcacatcgaacgtgaagaagcgcgtaacgcggaagacgcgcagtctaaagcggttctgaccgactggctgcgtgcgaaagcgtctttcgttctggaacgtctgaaagaaatggacgaaaaagaattctacgcgtgcgaaatccagctgcagaaatggtacggtgacctgcgtggtaacccgttcgcggttgaagcggaaaaccgtgttgttgacatctctggtttctctatcggttctgacggtcactctatccagtaccgtaacctgctggcgtggaaatacctggaaaacggtaaacgtgaattctacctgctgatgaactacggtaaaaaaggtcgtatccgtttcaccgacggtaccgacatcaaaaaatctggtaaatggcagggtctgctgtacggtggtggtaaagcgaaagttatcgacctgaccttcgacccggacgacgaacagctgatcatcctgccgctggcgttcggtacccgtcagggtcgtgaattcatctggaacgacctgctgtctctggaaaccggtctgatcaaactggcgaacggtcgtgttatcgaaaaaaccatctacaacaaaaaaatcggtcgtgacgaaccggcgctgttcgttgcgctgaccttcgaacgtcgtgaagttgttgacccgtctaacatcaaaccggttaacctgatcggtgttgaccgtggtgaaaacatcccggcggttatcgcgctgaccgacccggaaggttgcccgctgccggaattcaaagactcttctggtggtccgaccgacatcctgcgtatcggtgaaggttacaaagaaaaacagcgtgcgatccaggcggcgaaagaagttgaacagcgtcgtgcgggtggttactctcgtaaattcgcgtctaaatctcgtaacctggcggacgacatggttcgtaactctgcgcgtgacctgttctaccacgcggttacccacgacgcggttctggttttcgaaaacctgtctcgtggtttcggtcgtcagggtaaacgtaccttcatgaccgaacgtcagtacaccaaaatggaagactggctgaccgcgaaactggcgtacgaaggtctgacctctaaaacctacctgtctaaaaccctggcgcagtacacctctaaaacctgctctaactgcggtttcaccatcaccaccgcggactacgacggtatgctggttcgtctgaaaaaaacctctgacggttgggcgaccaccctgaacaacaaagaactgaaagcggaaggtcagatcacctactacaaccgttacaaacgtcagaccgttgaaaaagaactgtctgcggaactggaccgtctgtctgaagaatctggtaacaacgacatctctaaatggaccaaaggtcgtcgtgacgaagcgctgttcctgctgaaaaaacgtttctctcaccgtccggttcaggaacagttcgtttgcctggactgcggtcacgaagttcacgcggacgaacaggcggcgctgaacatcgcgcgttcttggctgttcctgaactctaactctaccgaattcaaatcttacaaatctggtaaacagccgttcgttggtgcgtggcaggcgttctacaaacgtcgtctgaaagaagtttggaaaccgaacgcgtaagaaatcatccttagcgaaagctaaggattttttttatctgaaatgtagggagaccctcaggttaaatattcactcaggaagttattactcaggaagcaaagaggattaca

SEQ ID NO: 80 - DNA, 3451 bp, Artificial Sequence
  Description of Artificial Sequence: Synthetic polynucleotide
aatcaggagagcgttttcaatcctacctctggcgcagttgatatgtcaaacaggttgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcagtaatacgactcactataggggtctcatctcgtgtgagataggcggagatacgaactttaagaggaggatataccatgcaccatcatcatcaccataaacgtatcaacaaaatccgtcgtcgtctggttaaagactctaacaccaaaaaagcgggtaaaaccggtccgatgaaaaccctgctggttcgtgttatgaccccggacctgcgtgaacgtctggaaaacctgcgtaaaaaaccggaaaacatcccgcagccgatctctaacacctctcgtgcgaacctgaacaaactgctgaccgactacaccgaaatgaaaaaagcgatcctgcacgtttactgggaagaattccagaaagacccggttggtctgatgtctcgtgttgcgcagccggcgccgaaaaacatcgaccagcgtaaactgatcccggttaaagacggtaacgaacgtctgacctcttctggtttcgcgtgctctcagtgctgccagccgctgtacgtttacaaactggaacaggttaacgacaaaggtaaaccgcacaccaactacttcggtcgttgcaacgtttctgaacacgaacgtctgatcctgctgtctccgcacaaaccggaagcgaacgacgaactggttacctactctctgggtaaattcggtcagcgtgcgctggacttctactctatccacgttacccgtgaatctaaccacccggttaaaccgctggaacagatcggtggtaactcttgcgcgtctggtccggttggtaaagcgctgtctgacgcgtgcatgggtgcggttgcgtctttcctgaccaaataccaggacatcatcctggaacaccagaaagttatcaaaaaaaacgaaaaacgtctggcgaacctgaaagacatcgcgtctgcgaacggtctggcgttcccgaaaatcaccctgccgccgcagccgcacaccaaagaaggtatcgaagcgtacaacaacgttgttgcgcagatcgttatctgggttaacctgaacctgtggcagaaactgaaaatcggtcgtgacgaagcgaaaccgctgcagcgtctgaaaggtttcccgtctttcccgctggttgaacgtcaggcgaacgaagttgactggtgggacatggtttgcaacgttaaaaaactgatcaacgaaaaaaaagaagacggtaaagttttctggcagaacctggcgggttacaaacgtcaggaagcgctgctgccgtacctgtcttctgaagaagaccgtaaaaaaggtaaaaaattcgcgcgttaccagttcggtgacctgctgctgcacctggaaaaaaaacacggtgaagactggggtaaagtttacgacgaagcgtgggaacgtatcgacaaaaaagttgaaggtctgtctaaacacatcaaactggaagaagaacgtcgttctgaagacgcgcagtctaaagcggcgctgaccgactggctgcgtgcgaaagcgtctttcgttatcgaaggtctgaaagaagcggacaaagacgaattctgccgttgcgaactgaaactgcagaaatggtacggtgacctgcgtggtaaaccgttcgcgatcgaagcggaaaactctatcctggacatctctggtttctctaaacagtacaactgcgcgttcatctggcagaaagacggtgttaaaaaactgaacctgtacctgatcatcaactacttcaaaggtggtaaactgcgtttcaaaaaaatcaaaccggaagcgttcgaagcgaaccgtttctacaccgttatcaacaaaaaatctggtgaaatcgttccgatggaagttaacttcaacttcgacgacccgaacctgatcatcctgccgctggcgttcggtaaacgtcagggtcgtgaattcatctggaacgacctgctgtctctggaaaccggttctctgaaactggcgaacggtcgtgttatcgaaaaaaccctgtacaaccgtcgtacccgtcaggacgaaccggcgctgttcgttgcgctgaccttcgaacgtcgtgaagttctggactcttctaacatcaaaccgatgaacctgatcggtatcgaccgtggtgaaaacatcccggcggttatcgcgctgaccgacccggaaggttgcccgctgtctcgtttcaaagactctctgggtaacccgacccacatcctgcgtatcggtgaatcttacaaagaaaaacagcgtaccatccaggcggcgaaagaagttgaacagcgtcgtgcgggtggttactctcgtaaatacgcgtctaaagcgaaaaacctggcggacgacatggttcgtaacaccgcgcgtgacctgctgtactacgcggttacccaggacgcgatgctgatcttcgaaaacctgtctcgtggtttcggtcgtcagggtaaacgtaccttcatggcggaacgtcagtacacccgtatggaagactggctgaccgcgaaactggcgtacgaaggtctgccgtctaaaacctacctgtctaaaaccctggcgcagtacacctctaaaacctgctctaactgcggtttcaccatcacctctgcggactacgaccgtgttctggaaaaactgaaaaaaaccgcgaccggttggatgaccaccatcaacggtaaagaactgaaagttgaaggtcagatcacctactacaaccgttacaaacgtcagaacgttgttaaagacctgtctgttgaactggaccgtctgtctgaagaatctgttaacaacgacatctcttcttggaccaaaggtcgttctggtgaagcgctgtctctgctgaaaaaacgtttctctcaccgtccggttcaggaaaaattcgtttgcctgaactgcggtttcgaaacccacgcggacgaacaggcggcgctgaacatcgcgcgttcttggctgttcctgcgttctcaggaatacaaaaaataccagaccaacaaaaccaccggtaacaccgacaaacgtgcgttcgttgaaacctggcagtctttctaccgtaaaaaactgaaagaagtttggaaaccggaaatcatccttagcgaaagctaaggattttttttatctgaaatgtagggagaccctcaggttaaatattcactcaggaagttattactcaggaagcaaagaggattaca

SEQ ID NO: 81 - DNA, 329 bp, Artificial Sequence
  Description of Artificial Sequence: Synthetic polynucleotide
tgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggctagcaccgcctatctcgtgtgagataggcggagatacgaactttaagaaggagatatacc

SEQ ID NO: 82 - DNA, 286 bp, Artificial Sequence
  Description of Artificial Sequence: Synthetic polynucleotide
tgccgtcactgcgtcttttactggctcttctcgctaaccaaaccggtaaccccgcttattaaaagcattctgtaacaaagcgggaccaaagccatgacaaaaacgcgtaacaaaagtgtctataatcacggcagaaaagtccacattgattatttgcacggcgtcacactttgctatgccatagcatttttatccataagattagcggatcctacctgacgctttttatcgcaactctctactgtttctccatacccgtttttttgggtagcggatcctacctgac

SEQ ID NO: 83 - DNA, 297 bp, Artificial Sequence
  Description of Artificial Sequence: Synthetic polynucleotide
aatcaggagagcgttttcaatcctacctctggcgcagttgatatgtcaaacaggtttctagagcacagctaacaccacgtcgtccctatctgctgccctaggtctatgagtggttgctggataactttacgggcatgcataaggctcgtaatatatattcagggagaccacaacggtttccctctacaaataattttgtttaacttttactagagctagcagtaatacgactcactataggggtctcatctcgtgtgagataggcggagatacgaactttaagaggaggatatacca

SEQ ID NO: 84 - DNA, 36 bp, Artificial Sequence
  Description of Artificial Sequence: Synthetic oligonucleotide
gtttgagagatatgtaaattcaaaggataatcaaac

SEQ ID NO: 85 - DNA, 29 bp, Artificial Sequence
  Description of Artificial Sequence: Synthetic oligonucleotide
actacattttttaagacctaattttgagt

SEQ ID NO: 86 - DNA, 35 bp, Artificial Sequence
  Description of Artificial Sequence: Synthetic oligonucleotide
ctcaaaactcattcgaatctctactctttgtagat

SEQ ID NO: 87 - DNA, 36 bp, Artificial Sequence
  Description of Artificial Sequence: Synthetic oligonucleotide
ctctagcaggcctggcaaatttctactgttgtagat

SEQ ID NO: 88 - DNA, 38 bp, Artificial Sequence
  Description of Artificial Sequence: Synthetic oligonucleotide
ccgtctaaaactcattcagaatttctactagtgtagat

SEQ ID NO: 89 - DNA, 32 bp, Artificial Sequence
  Description of Artificial Sequence: Synthetic oligonucleotide
gtctaggtactctctttaatttctactattgt

SEQ ID NO: 90 - DNA, 35 bp, Artificial Sequence
  Description of Artificial Sequence: Synthetic oligonucleotide
gttaagttatatagaataatttctactgttgtaga

SEQ ID NO: 91 - DNA, 33 bp, Artificial Sequence
  Description of Artificial Sequence: Synthetic oligonucleotide
gtttaaaaccactttaaaatttctactattgta

SEQ ID NO: 92 - DNA, 122 bp, Artificial Sequence
  Description of Artificial Sequence: Synthetic polynucleotide
gtttgagaatgatgtaaaaatgtatggtacacagaaatgttttaataccatatttttacatcactctcaaacatacatctcttgttactgtttatcgtatccagattaaatttcacgttttt

SEQ ID NO: 93 - DNA, 36 bp, Artificial Sequence
  Description of Artificial Sequence: Synthetic oligonucleotide
ctctacaactgataaagaatttctacttttgtagat

SEQ ID NO: 94 - DNA, 36 bp, Artificial Sequence
  Description of Artificial Sequence: Synthetic oligonucleotide
gtctggccccaaattttaatttctactgttgtagat

SEQ ID NO: 95 - DNA, 35 bp, Artificial Sequence
  Description of Artificial Sequence: Synthetic oligonucleotide
gtcaaaagacctttttaatttctactcttgtagat

SEQ ID NO: 96 - DNA, 85 bp, Artificial Sequence
  Description of Artificial Sequence: Synthetic oligonucleotide
gtctagaggacagaatttttcaacgggtgtgccaatggccactttccaggtggcaaagcccgttgagcttctacggaagtggcac

SEQ ID NO: 97 - DNA, 105 bp, Artificial Sequence
  Description of Artificial Sequence: Synthetic polynucleotide
cgaggttctgtcttttggtcaggacaaccgtctagctataagtgctgcaggggtgtgagaaactcctattgctggacgatgtctcttttaacgaggcattagcac

SEQ ID NO: 98 - DNA, 119 bp, Artificial Sequence
  Description of Artificial Sequence: Synthetic polynucleotide
gaacgagggacgttttgtctccaatgattttgctatgacgacctcgaactgtgccttcaagtctgaggcgaaaaagaaatggaaaaaagtgtctcatcgctctacctcgtagttagagg

SEQ ID NO: 99 - DNA, 23 bp, Artificial Sequence
  Description of Artificial Sequence: Synthetic oligonucleotide
aattactgatgttgtgatgaagg

SEQ ID NO: 100 - DNA, 23 bp, Artificial Sequence
  Description of Artificial Sequence: Synthetic oligonucleotide
tataccataaggatttaaagact

SEQ ID NO: 101 - DNA, 25 bp, Artificial Sequence
  Description of Artificial Sequence: Synthetic oligonucleotide
gtctttactctcacctttccacctg

SEQ ID NO: 102 - DNA, 37 bp, Artificial Sequence
  Description of Artificial Sequence: Synthetic oligonucleotide
atttgaaggtatctccgataagtaaaacgcatcaaag

SEQ ID NO: 103 - DNA, 37 bp, Artificial Sequence
  Description of Artificial Sequence: Synthetic oligonucleotide
gtttgaagatatctccgataaataagaagcatcaaag

SEQ ID NO: 104 - DNA, 36 bp, Artificial Sequence
  Description of Artificial Sequence: Synthetic oligonucleotide
ttgttttaataccatatttttacatcactctcaaac

SEQ ID NO: 105 - DNA, 103 bp, Artificial Sequence
  Description of Artificial Sequence: Synthetic polynucleotide
aaagaacgctcgctcagtgttctgacctttcgagcgcctgttcagggcgaaaaccctgggaggcgctcgaatcataggtgggacaagggattcgcggcgaaaa

SEQ ID NO: 106 - DNA, 122 bp, Artificial Sequence; identical to SEQ ID NO: 92
  Description of Artificial Sequence: Synthetic polynucleotide

SEQ ID NO: 107 - DNA, 85 bp, Artificial Sequence; identical to SEQ ID NO: 96
  Description of Artificial Sequence: Synthetic oligonucleotide

SEQ ID NO: 108 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 109 - protein, 1300 aa, Artificial Sequence
  Description of Artificial Sequence: Synthetic polypeptide
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSDDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQVAPKNLDNPSKKEQDLIAKKTEKAKYLSLETIKLALEEFNKHRDIDKQCRFEEILANFAAIPMIFDEIAQNKDNLAQISLKYQNQGKKDLLQASAEEDVKAIKDLLDQTNNLLHRLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGNPQKGYEKFEFNIEDCRKFIDFYKESISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEHNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLDRIKNNQEGKKLNLVIKNEEYFEFVQNRNN

SEQ ID NO: 110 - protein, 1368 aa, Artificial Sequence [sequence omitted]

SEQ ID NO: 111 - protein, 7 aa, Simian virus 40
PKKKRKV

SEQ ID NO: 112 - protein, 16 aa, Unknown
  Description of Unknown: Nucleoplasmin bipartite NLS sequence
KRPAATKKAGQAKKKK

SEQ ID NO: 113 - protein, 9 aa, Unknown
  Description of Unknown: C-myc NLS sequence
PAAKRVKLD

SEQ ID NO: 114 - protein, 11 aa, Unknown
  Description of Unknown: C-myc NLS sequence
RQRRNELKRSP

SEQ ID NO: 115 - protein, 38 aa, Homo sapiens
NQSSNFGPMKGGNFGGRSSGPYGGGGQYFAKPRNQGGY

SEQ ID NO: 116 - protein, 42 aa, Unknown
  Description of Unknown: IBB domain from importin-alpha sequence
RMRIZFKNKGKDTAELRRRRVEVSVELRKAKKDEQILKRRNV

SEQ ID NO: 117 - protein, 8 aa, Unknown
  Description of Unknown: Myoma T protein sequence
VSRKRPRP

SEQ ID NO: 118 - protein, 8 aa, Unknown
  Description of Unknown: Myoma T protein sequence
PPKKARED

SEQ ID NO: 119 - protein, 8 aa, Homo sapiens
PQPKKKPL

SEQ ID NO: 120 - protein, 12 aa, Mus musculus
SALIKKKKKMAP

SEQ ID NO: 121 - protein, 5 aa, Influenza virus
DRLRR

SEQ ID NO: 122 - protein, 7 aa, Influenza virus
PKQKKRK

SEQ ID NO: 123 - protein, 10 aa, Hepatitis delta virus
RKLKKKIKKL

SEQ ID NO: 124 - protein, 10 aa, Mus musculus
REKKKFLKRR

SEQ ID NO: 125 - protein, 20 aa, Homo sapiens
KRKGDEVDGVDEVAKKKSKK

SEQ ID NO: 126 - protein, 17 aa, Homo sapiens
RKCLQAGMNLEARKTKK

SEQ ID NO: 127 - DNA, 4098 bp, Artificial Sequence
  Description of Artificial Sequence: Synthetic polynucleotide
atgggtaagatgtattatctgggtttggatataggcactaactctgtgggatatgcagtaactgatccctcgtatcacttgttaaagttcaaaggcgaacccatgtggggagcacatgtatttgctgcgggtaatcagagtgccgaaaggcgatctttcagaacatccaggaggcgattagataggagacagcaaagagtaaagcttgtgcaagagatctttgctcctgtcatttcacctatagaccctcgtttttttataagattgcacgaatcggctctatggagagacgatgttgccgaaacagataaacatatctttttcaatgatcccacttatacagacaaggaatactactccgactacccgacaattcatcatttgatcgtcgatcttatggagagctctgaaaagcatgacccccgacttgtctatttggctgtagcttggttagttgctcatagaggtcatttcttgaatgaagtagataaagacaatataggtgatgtactttcttttgatgctttctacccggaatttttggcctttttgtcagacaatggcgtcagtccctgggtctgtgagtcgaaggcccttcaagctactctgctgtctaggaatagcgtcaacgacaaatataaagcattaaaatcgctgatattcggatcgcaaaaaccggaagataactttgacgctaacatctctgaagatggtttaatccaattgctggcgggtaagaaagttaaagtaaacaaactattcccacaagagtccaacgatgctagctttacgttgaatgataaagaagacgctattgaagaaattctaggtactttaacgcctgacgagtgcgaatggatcgctcatattcgcagattgttcgattgggccatcatgaaacacgcgctaaaggatggcaggacgatatctgaatcaaaagtgaagctatacgagcagcatcatcatgacttgactcagttaaagtactttgtgaagacctacctagctaaagagtatgatgatatcttcagaaacgtagactccgagacaactaaaaattatgtagcttattcttaccatgtgaaggaagtgaaaggcacattaccaaaaaataaagcaacgcaagaagaattttgtaaatacgtccttggcaaagtcaaaaacattgaatgttccgaagcagacaaggttgattttgatgaaatgatacaacgacttacggacaattcttttatgccaaagcaagtctcaggtgaaaatagagtaataccataccagttgtactactatgaattaaagacaattttaaacaaagccgcctcatatctaccttttttgacacaatgcggtaaagatgctatttctaaccaagacaaattactgtctataatgacatttcgcataccatatttcgtcggccctttaaggaaagataattcagaacatgcctggttggaacgtaaagcgggtaaaatttacccgtggaactttaatgataaagtagatcttgataaatcggaggaagcctttatccgtaggatgaccaatacttgcacgtattacccaggagaagacgtgttaccattagattcacttatctatgaaaagtttatgatcttgaatgagataaacaatattaggattgacggataccccatttctgttgatgtgaaacaacaagtatttggtttatttgagaagaaaaggcgagtaacagttaaggatattcaaaatctactattatctcttggagcgttggataaacacggtaagctgactggtattgacacgacaatacactctaattataacacttatcatcattttaaatctcttatggagcggggagtattgaccagagatgatgtggaaagaatagtggaaagaatgacatattctgacgatactaagagggtcagactgtggttaaataataattatggaactctaacagctgacgatgttaagcatatctcaagactcagaaaacacgatttcggccgtttgtctaaaatgtttttgacaggattgaaaggtgttcataaggagacaggcgagagagcaagtatactggattttatgtggaatactaacgacaatttaatgcaactactgtccgaatgttacacattctcggatgagatcaccaaattacaagaggcctactacgcaaaagctcaattatcgctaaatgacttcttggactctatgtatatatcaaacgccgttaagagacctatttatcggaccttagcggtagtaaatgatattagaaaggcatgcgggacggcacctaaaagaattttcatcgagatggcgcgagatggagagtctaagaagaaaagatctgtgactcgtagagagcaaattaaaaatctctatagatcaattcgtaaagactttcaacaagaagttgattttctggaaaagatattggaaaataagagtgacgggcagcttcagtctgacgctttatatttgtattttgctcaattaggcagagacatgtacacaggtgatccaatcaaattagaacatattaaagaccaatctttttacaacattgatcatatttatcctcaatcgatggtgaaagatgacagtttggataacaaggtactagtccaaagcgaaatcaatggcgaaaagagttcgcgctatccattagacgcagccattagaaacaaaatgaagccgttgtgggatgcctactataatcatggattaatttctcttaagaaataccagcgtttgacgagatctactccatttacggacgacgagaagtgggattttatcaatcgtcagctagttgaaactaggcaatctactaaagctttagcaatattgttaaagcgtaagtttccagatactgaaatagtttactcaaaggctggactatccagcgattttagacatgaattcggcctggttaagagtaggaatattaatgatctacaccatgctaaagatgcctttctcgcaatagttactgggaacgtttatcatgaaagatttaatagaagatggtttatggttaaccagccatactctgtgaaaactaagacattgtttacccattcaattaagaatggcaactttgtcgcttggaatggagaagaagatcttggacgtatcgtaaagatgttgaaacaaaacaagaacacaatccacttcaccaggttttcctttgataggaaggagggattgttcgatattcaacctctcaaagcttctaccggattggttccacgaaaagcagggttggatgttgttaaatatggaggatacgataaaagcactgccgcgtattatttattagtacgttttacactcgaggataagaagactcaacacaaattgatgatgattcctgttgaaggtctctacaaagcacgtattgaccatgataaagagtttttaacagattatgctcagaccacgatcagcgaaattcttcaaaaggacaagcagaaagtgatcaacatcatgttccctatgggcacgagacatatcaaactgaattcgatgatttctattgatggattctatctttctattggtgggaagagtagcaaaggtaagtcagtactatgtcatgctatggtgccattaatcgtcccacacaagatagaatgttatatcaaggctatggaatcgtttgcaagaaaattcaaagaaaataataaattgaggatcgttgaaaagtttgataaaataactgttgaagataacttgaacttatacgagctttttctacaaaagttgcaacataacccatataataaatttttctctacacaatttgatgtgttgacgaacggtagaagtacattcaccaaattgtctccagaggagcaagtccagactttacttaatatactgagtatatttaaaacttgtcgttcttctgggtgtgatttaaaatcaataaatggttccgctcaagcggctagaattatgatatccgctgatttaactggcttatcaaaaaagtattcagatattagattagttgagcaaagcgcatcaggtctatttgtttcaaaatctcaaaatctcttggaatacttgccaaaaaagaaaaggaaagtttag

SEQ ID NO: 128 - DNA, 4005 bp, Artificial Sequence
  Description of Artificial Sequence: Synthetic polynucleotide
atgagtagtttaacaaagtttaccaataaatatagtaagcaactaactataaagaacgaattgataccggtcggtaagactttggaaaacataaaagaaaatgggttgattgatggagacgagcaattgaatgagaattatcaaaaagcaaagataatagtagatgattttttgagagactttattaataaagctctaaataacactcaaattggtaactggagagagctagccgacgccttgaacaaggaagatgaggataatattgagaaattacaagataagattagagggattatcgtgtctaagtttgagacttttgatctgttcagttcgtattcgattaaaaaggacgagaaaatcatcgatgatgataacgatgtggaagaagaggagctagaccttgggaagaagacatctagcttcaaatacatattcaagaaaaatttgttcaaacttgtccttccttcatatttaaaaacaacaaatcaagataagttaaaaatcatttcttccttcgataattttagtacttattttcgtggttttttcgaaaacaggaaaaatatattcactaaaaagcctatatctacctctatagcttatagaattgttcacgataatttcccaaaatttctagataatatcaggtgttttaatgtttggcaaaccgagtgtcctcagttaatagtcaaggccgacaactaccttaaaagcaagaatgtgattgcaaaagataagtctttggctaactattttacagtcggtgcctatgattattttctgagtcaaaatggtatcgatttctataacaacattattggcggcttaccagcttttgccgggcatgagaagattcagggtttgaacgaatttatcaatcaagaatgtcaaaaggattctgaattaaagtctaagctcaagaataggcacgctttcaaaatggcagtcttattcaaacaaatcctttcagacagagaaaagtcatttgtgattgacgagttcgaatcagacgctcaggtaattgatgctgttaaaaatttttacgcggaacaatgcaaagataataacgtcatatttaatttattgaatctgatcaagaatattgcttttttgtcggatgatgagttagacggcattttcatagagggtaaatacctgtcctctgtgtctcaaaaattgtatagtgattggtcaaagttgagaaatgatattgaagattcggctaattctaaacagggtaacaaagaattagcgaagaaaatcaaaactaacaagggtgatgttgaaaaggctataagtaagtacgagttcagtttatctgaactaaattcaattgttcatgataacacaaaattttccgatcttttatcatgcacattacataaagttgcaagtgaaaaattagtcaaagtaaacgaaggtgattggccaaaacatctaaaaaacaacgaggaaaaacagaagataaaagaacctcttgacgctttattggaaatatacaatactctattaatatttaactgtaaaagttttaacaaaaatggtaatttctatgtcgactacgatcgctgcattaatgagttgtccagtgttgtgtacttgtataataaaactcgtaattattgtacgaaaaagccgtacaacactgacaaatttaagttgaatttcaactccccacaactgggtgagggcttctctaaaagtaaagagaatgattgccttacattattatttaaaaaagatgataattattatgtcggaatcataagaaagggggcaaagatcaacttcgatgacactcaggccatagcagacaacacagataactgtatattcaaaatgaattattttttgctgaaggatgctaaaaaatttatccccaaatgttcaatacaattaaaagaggttaaggcccatttcaaaaagtcggaagatgactatattttgtccgataaggaaaaattcgctagtccgcttgttattaaaaaatccacatttcttctcgctacggctcatgtgaaaggaaagaagggcaatattaagaaatttcagaaagaatactccaaagaaaatcctacggagtatagaaatagtctgaacgaatggatagcattctgcaaagagttcttgaagacctataaagctgccaccatctttgatattacaactttgaaaaaggccgaggaatacgctgacattgtggaattctataaggatgtagataatctttgttacaagttagaattttgccctatcaaaacttcttttatcgaaaatcttatagataatggcgatttatacctgtttagaattaataacaaggacttttcttcaaaaagtacaggcacgaaaaacttacacacattatacttgcaggctatatttgacgagcgaaacttaaacaaccccacgataatgttgaatggaggtgcagagttattctacagaaaagaatctatagaacagaaaaatcggatcacgcacaaagccggtagtatcttagtgaataaagtgtgcaaagatggtacaagtctagatgacaaaatccgtaacgaaatttaccagtatgaaaacaaattcattgatactctttcggacgaagctaaaaaggttctgccaaacgttattaagaaagaggctacgcatgatataacaaaagataaacgtttcactagcgacaaattcttctttcattgtcctttaacaatcaactacaaggaaggtgacaccaaacaatttaataatgaagtgctctcattccttagaggtaaccccgatatcaatattatcggcattgatagaggagaaagaaacctaatctatgtaacagtcattaaccaaaaaggcgaaatattggatagcgtctccttcaatactgtcaccaataagtcatcgaagatagaacaaactgttgattacgaagaaaaattggccgttagagaaaaggaacgtatcgaagcgaagagatcttgggatagcatatccaagattgccaccttgaaggagggttatctaagcgcgatcgtacatgaaatctgcttattaatgattaagcataatgctattgtcgtgttagaaaacctgaatgccggttttaaaaggattagaggtggtttgtcagaaaagtcagtatatcaaaagtttgaaaagatgcttattaataaactcaactacttcgttagcaagaaagaaagtgattggaataaaccgtcaggtttgctcaatggtcttcagttaagtgatcaatttgagtctttcgaaaaattaggaattcaaagtggattcattttttatgtaccagccgcgtacacttcaaaaattgaccctacgaccggatttgccaacgtcttgaatttgtccaaggtcagaaatgttgacgccatcaaaagtttttttagcaacttcaatgaaatctcttattccaaaaaggaagcccttttcaagttttcttttgacctagactcgttatcgaagaaaggattttcatctttcgtaaagtttagcaagtccaagtggaatgtatacacattcggcgagagaattatcaagcccaagaacaaacagggctatagagaagacaagagaatcaacttgacttttgagatgaaaaaattactcaacgaatacaaggtttcatttgatttggagaacaacttgattcccaatttgacatcagctaacttgaaggatacgttctggaaggagttattctttatattcaaaacgacattacaactgcgtaatagtgttacaaacggtaaagaagatgtattaatctcacctgtaaagaatgccaaaggagaatttttcgtatccggtactcacaataagacactaccacaggattgcgacgctaacggtgcgtatcatattgcgttgaaaggattaatgatacttgaaagaaataaccttgttcgcgaagaaaaagacaccaagaagatcatggctattagcaatgttgattggtttgaatacgtgcaaaagaggagaggtgttttgtaa

SEQ ID NO: 129 - DNA, 3717 bp, Artificial Sequence
  Description of Artificial Sequence: Synthetic polynucleotide
atgaacaattatgacgagttcacaaagctataccctatccaaaaaactatcaggttcgaattgaaaccacaagggagaacaatggaacatctggagacattcaacttttttgaagaggacagagacagagcggagaaatacaaaattttaaaagaggccatcgatgaatatcacaaaaagtttatcgacgagcatttaacaaacatgtctttggactggaattcacttaaacaaatttctgagaaatattataagtctcgggaggaaaaagacaaaaaggtctttttgtccgagcaaaagagaatgagacaagaaattgtctcggagtttaaaaaagatgatcggttcaaagatttgtttagcaagaaattgttttctgaattgttgaaggaggagatatacaagaaaggcaaccatcaagaaatagatgctttgaaatcgtttgacaagttcagcggttacttcattggtttacatgaaaataggaagaacatgtatagcgacggcgatgagatcaccgctatatcgaatagaatcgttaacgaaaattttccgaaatttttggataatttgcaaaaataccaggaagctaggaaaaagtaccctgaatggataataaaggcggaatcagctttggtggctcacaacataaagatggatgaagtcttctcgctggaatattttaacaaagtattaaatcaggaaggaatccaaagatacaacttagccttgggtggatacgtaaccaaatcaggtgagaaaatgatgggcttaaatgatgcacttaatctagctcaccaatccgaaaagtcctctaaagggaggatacacatgacaccattgtttaagcaaatcctttcggagaaagaatctttttcatatatccccgatgttttcactgaggatagtcaattgttgcccagcattggtggattttttgcacaaatagaaaatgataaagatggtaacatcttcgatagagccttggaattgataagctcctatgcagaatacgatacggaacgaatatacattagacaagctgacatcaacagagtaagcaatgttatttttggtgagtggggaactttaggtggattaatgcgggagtacaaagctgactcaatcaatgatattaatttggaacgtacgtgcaaaaaagtcgataagtggcttgatagtaaggagtttgctctgtcggatgtactagaagcaattaagagaacaggaaacaatgatgcatttaatgaatatattagtaaaatgaggacggctagagaaaagatagacgccgcacgtaaggaaatgaagtttatttccgagaaaatatctggcgatgaagagtcgattcacatcatcaagaccctactcgattctgttcagcaatttctccatttttttaacctcttcaaagcaagacaagacattcccttagatggggctttttatgccgaatttgatgaagttcattcaaagttgtttgctattgttcctctttacaataaggtccgtaattaccttactaaaaataacttgaacaccaagaaaataaagttaaacttcaagaatccgactcttgccaacgggtgggatcagaataaagtttatgattatgctagcttaatatttctaagagatgggaattattacttaggaatcatcaatccaaagcgtaagaaaaacattaaatttgaacaagggtcaggcaatggcccattctatagaaaaatggtgtataagcaaataccaggacctaacaagaacttgcctcgcgtatttttaacttcaacaaagggtaaaaaagaatataaaccaagcaaagaaattattgaaggttacgaagcagataaacacatcagaggtgataagttcgatctggatttctgccataaattgattgacttttttaaggaatctatagaaaaacataaggactggtccaaatttaatttctacttctcacctacagaaagttatggtgacatttcagaattttatttagacgttgagaaacaaggatataggatgcattttgaaaatatttcagcggaaaccatcgacgaatacgttgagaagggtgatttattcttgttccaaatttacaataaagacttcgttaaagctgcaaccggaaagaaggatatgcataccatatattggaacgctgcattctcgccagaaaacttacaagatgtcgttgtaaagcttaatggagaagctgagctgttctatagagacaagagtgatataaaagagattgtgcatcgggaaggtgaaattctggtgaacagaacttacaatggtcgtacacccgttccagacaaaatacataaaaaactgaccgattatcataatggtaggacaaaggacttgggcgaggccaaggagtacctcgataaagttagatatttcaaggcacactatgatattacgaaagacaggagatatttaaacgataaaatttactttcatgtccctttgacccttaactttaaagctaatggtaaaaagaatttgaacaaaatggtaattgagaagtttttatcggacgaaaaagctcacataatcggaatcgaccgcggagagagaaatttactgtattatagtatcatcgacagaagtggaaagattattgatcagcaatctttgaacgtcattgatgggtttgactatcgggaaaagttaaatcaaagggaaattgaaatgaaggatgcgagacaatcatggaatgccattggtaaaattaaagatctcaaggaggggtacttatcaaaagctgtacacgagataactaaaatggctatccaatataatgcaattgttgtaatggaagaattgaattatggttttaaacgcggcaggtttaaagtcgaaaaacaaatataccaaaagtttgaaaacatgttaattgataagatgaactatcttgttttcaaagatgcacctgatgagagtcctggcggtgtgctgaacgcctatcaattaacaaacccattagagtcctttgctaaactgggtaaacaaactggcattctattttatgttccagccgcttacacctcaaagatcgatccaacgaccggttttgtaaacttatttaatacttcttccaaaacaaacgcgcaagaacgcaaagaattcctacaaaaatttgaatcaatatcctatagcgcaaaagatggaggtatattcgctttcgcttttgactacagaaagtttggcacttccaagacagatcataaaaatgtgtggaccgcttataccaacggagaaaggatgcgttatattaaagaaaaaaagaggaacgaactatttgatccatcgaaagaaattaaagaagctttgacaagcagcggaatcaaatatgatggaggtcaaaacatacttccagatattctcagatctaataataacggtcttatttacacgatgtattcatcttttatcgctgccatccaaatgcgtgtgtatgatggcaaggaagattatattatatctcctattaaaaattcaaagggtgaattttttcgcacggatccaaaaagaagagagcttccaattgacgccgatgctaacggtgcttacaatattgcattgcgtggtgaacttactatgagagccatcgccgaaaagtttgatccggacagtgaaaaaatggcgaaattggagctaaagcacaaggattggtttgaattcatgcagacccgtggcgattga

SEQ ID NO: 130 - DNA, 3897 bp, Artificial Sequence
  Description of Artificial Sequence: Synthetic polynucleotide
atgactaaaacgttcgactccgagttttttaatctctattccttgcaaaagaccgttaggtttgaattgaaaccagttggtgaaactgcctcatttgtcgaagactttaaaaacgagggattgaaaagagtggttagtgaagatgaaagaagggcagtagactatcaaaaggttaaagaaatcattgacgattaccacagagattttatagaagaatctctgaactattttccagagcaggtttcaaaagatgctctagagcaagcgtttcatttgtatcaaaagttgaaagcagcgaaggtggaagaaagggaaaaagctttaaaagaatgggaagcattacagaaaaaattgcgagaaaaagtcgtcaaatgtttcagcgactctaataaagctcgcttttctagaatcgataaaaaagaattgattaaggaagatttaataaattggctggtagcacaaaacagagaggatgatattcctactgttgaaacgttcaataattttactacttacttcactggtttccatgagaacaggaagaatatttactctaaagatgatcacgctactgctataagttttaggttgattcacgaaaacttgcctaaattttttgacaatgtcatcagttttaacaagttgaaagaaggtttcccggaattaaaattcgacaaagttaaagaagatttagaagtagattacgacttgaagcatgcgtttgaaattgaatatttcgttaatttcgtcacacaagctggtatcgaccaatataattacctgcttggaggcaaaactctagaagacggtacgaagaaacaaggaatgaatgaacagattaatttatttaagcaacaacaaactcgcgataaagctagacagattccaaaactgattccacttttcaaacagattctatctgagagaactgaatctcagagttttatccctaagcagttcgagtctgatcaggaactattcgattccctgcagaaattgcataacaactgtcaagataagtttaccgttttgcaacaggcgatcttgggattggctgaggcagatcttaaaaaggtctttattaaaactagtgatctaaacgcattgtctaacactatttttggaaattattctgtgttctcagacgcgctcaatttatataaagagtcgctaaaaactaaaaaggctcaagaagcttttgaaaagttgcctgcacatagtattcatgatttaatccaatacttagaacaatttaattcgtctctcgatgctgaaaagcaacagtctaccgatactgtattaaactactttattaaaaccgacgaattatatagtcgtttcattaaatccacctctgaggcattcacccaagtacaacctctctttgaactggaagctttgagctccaaaagaagacccccagaaagtgaagatgagggggctaaaggccaagaaggtttcgaacaaattaagagaatcaaagcttatctagacactctaatggaggctgtccactttgctaagcctttgtatcttgtcaagggtagaaagatgatagagggtctagacaaggatcaaagcttctacgaagcgtttgaaatggcctaccaggagttggagtctttaatcatccccatttacaataaggccagatcttacctgtctaggaagccatttaaagcggataaattcaaaattaattttgacaataatacacttctatctgggtgggatgctaacaaggagacggctaacgccagcatattgtttaagaaggatggtttatactacctgggaatcatgccaaaaggcaaaactttcttgttcgattatttcgttagttcagaagattctgaaaagttgaaacaacggagacagaaaaccgcagaggaagcgctcgcacaggatggagaatcctattttgaaaaaatacggtataaactcctaccaggtgctagtaagatgttgccaaaggtattttttagcaataaaaatattgggttttacaatccctcagatgatattctacgaattcggaatacggcctctcatactaagaatggtactccccagaagggtcattccaaggtagaatttaacttgaatgactgtcacaaaatgattgatttttttaaatcttccatacagaaacatcccgagtggggatcctttggtttcactttttctgatacgtcggactttgaagatatgagtgctttctaccgagaagttgaaaatcaaggttacgttataagttttgataaaataaaagaaacttacattcagtctcaagttgagcaaggtaacttatatttatttcaaatttacaacaaagattttagtccgtattcaaagggaaagccaaacctgcacactttatactggaaagctctgtttgaagaggctaatttgaataacgtagtggctaagctaaacggcgaagcagaaatctttttcagaagacacagtatcaaagcatctgataaagtggtacatcctgctaatcaagctatagataataagaatccccatactgagaagacgcagtccacatttgaatatgacttggtcaaagacaaaagatatacccaagacaaatttttttttcatgtaccgatatctttaaactttaaggctcagggcgtttcaaagtttaatgataaggtaaatggattcttaaagggcaatcccgacgttaatataatcggtatagatcgaggtgagagacatcttttatactttaccgtggtgaatcaaaaaggagaaatattagtgcaagagtccttgaatacattaatgtctgacaagggtcatgtcaacgattatcaacagaaattggacaagaaggaacaggaaagggacgctgccaggaagtcctggacgacagtagaaaatattaaagaattaaaagaaggttatttatcacatgtggttcataaacttgcacatttaatcatcaaatataacgcaatagtgtgcttggaagatcttaattttggcttcaagaggggtaggttcaaggtcgaaaaacaggtctaccagaagttcgagaaagctctgatcgataaattgaattatcttgttttcaaagaaaaagaattaggagaagttggtcattatcttacagcataccaactcactgcaccatttgaaagcttcaaaaagctaggcaagcaatctgggattttgttctatgttccggctgattatacatcaaagatagatcctaccacaggctttgtaaattttttagatcttaggtaccaatccgttgaaaaagctaaacagttgctgtccgattttaatgcgataagatttaatagtgttcagaattattttgagttcgaaattgattataaaaaattgacaccaaaacgtaaagtaggaacacaatctaaatgggttatttgtacctatggagatgttagataccaaaacagaagaaatcagaaaggtcactgggaaactgaagaagttaacgttactgaaaaacttaaagctctatttgcgagcgattcaaaaacgacgacggtgatcgattatgcaaatgatgataaccttattgatgtaattctggaacaagataaggcatcattttttaaagaactactatggttgttaaagctaaccatgaccctaaggcactccaagataaagtcagaggatgattttatcctctctccagtgaaaaacgaacaaggtgagttttacgactcaagaaaggcgggtgaagtctggcctaaggatgctgatgccaatggagcttatcacatcgctctgaaggggctatggaacttacagcaaattaaccaatgggaaaaaggtaaaactttaaacctcgccataaagaaccaggattggttcagctttatccaagaaaaaccatatcaagaataa

SEQ ID NO: 131 - DNA, 3708 bp, Artificial Sequence
  Description of Artificial Sequence: Synthetic polynucleotide
atgcacacaggaggtctactctcgatggatgctaaggaatttaccggtcaatatccgctgtccaaaactttgcgttttgagcttagacctattggccgaacgtgggataacctagaggcttctggttatttggcggaagatagacatagagctgagtgttatccccgagctaaagaattgctggatgataaccacagggcgttcctgaatagagttctaccgcaaatcgatatggattggcatccaattgctgaagctttctgcaaggtgcacaaaaatccaggtaataaagaattggctcaggattataatttgcagcttagtaagagaagaaaagaaatttccgcttatttgcaggatgctgatggatacaaggggttgttcgcgaaacctgccctggacgaagctatgaaaatagctaaggaaaacggcaatgaatctgatattgaagttttggaagccttcaatggattttccgtttatttcactggttatcatgagagtagggagaatatatactcagacgaagatatggtatccgtcgcctatcgcataactgaagataattttccaaggttcgtgtcgaacgcgttaatttttgataaactaaatgaatcgcacccggatattatttcggaagtgtccggtaatctgggggtagacgatattggtaaatattttgatgtgtccaactacaataatttccttagtcaagcaggaattgatgactacaaccatattataggagggcatacaactgaagacggtctcattcaagcttttaacgtagtgttaaacctaaggcaccaaaaagacccaggttttgagaaaattcaatttaagcaactctacaagcagatactgagcgttaggactagtaagtcatatatcccaaagcaattcgataactcaaaggaaatggtcgactgtatatgcgactacgtctcaaaaatagaaaaatctgaaacagtagaaagagctctgaaattggtaagaaatatatcttcttttgatttaagaggtattttcgtaaataaaaaaaaccttcgaattttgtctaataagttaattggagactgggacgcaatagagacagctttgatgcacagttccagcagtgaaaacgataagaaatcagtgtatgactctgcagaggcattcacccttgatgatatcttcagttctgtgaaaaagttcagcgacgcctccgctgaggatataggaaaccgcgctgaagacatatgtcgtgttatctcagaaacagctcctttcattaacgacttaagggctgtagatttggattctttaaatgatgacggctatgaagcggccgtgtctaaaatacgggaatctcttgaaccctacatggatctatttcacgaattggagatctttagcgtgggtgatgagtttcctaaatgtgctgccttttatagcgagttggaagaggtctcagaacaactgattgaaatcattcctttatttaacaaagcaagaagtttttgcacaaggaaaaggtattcaaccgacaaaatcaaagtcaatttaaaattccctactctggcagatggatgggatctaaataaagaaagggataacaaagccgcaattctaagaaaagacggtaaatactacctggcaattttagacatgaagaaagatctcagtagtattcgtacgagcgatgaggacgagtcttcttttgaaaagatggaatataaattgctcccttctcctgtgaaaatgcttccaaaaatttttgttaaatcgaaagccgccaaagaaaagtacgggttgaccgatagaatgttagaatgctacgataaaggtatgcataagtcgggtagtgcttttgatttgggtttttgtcatgaattgatcgattactataagcgctgcattgccgagtacccaggctgggatgttttcgactttaaatttcgtgagacaagcgattacggatccatgaaagaatttaatgaagacgtcgctggcgcaggttactatatgtcacttagaaagattccatgttccgaagtttatcgtttactggacgagaagtcaatttacttgtttcaaatatataataaggattatagcgaaaacgcacatgggaataagaatatgcatacgatgtattgggagggcttgttctcaccacaaaatttggaatcaccagtcttcaaattgtccggaggcgcagaactttttttcagaaagtcatctattcctaatgacgctaaaacggtacatccgaaaggttcagttcttgttcccagaaacgacgtcaatggtagaagaataccagactcgatctacagagagttgacaaggtattttaaccgtggggattgcaggatcagtgatgaagctaagtcttacctggacaaggtcaagacaaaaaaagcggaccatgacattgttaaggatagaagatttactgtagataagatgatgttccatgttccgattgccatgaattttaaagctataagtaaaccaaatcttaataagaaagttattgatggcataatagatgatcaagatttgaaaatcatcggtatcgatcgtggtgagagaaatcttatttatgtgaccatggtcgataggaaggggaatatattgtatcaagacagtcttaatattttaaatggatacgattaccgcaaagctttagacgtgagggaatatgataacaaagaagctagaaggaattggactaaagtagaaggtattagaaaaatgaaagaaggttatttatctttagctgttagtaaattggccgatatgatcatcgaaaataatgctataatcgtaatggaagatttgaatcacgggtttaaggcaggtcgttccaaaattgaaaagcaggtgtatcaaaaattcgaatcaatgttaatcaacaagttaggatacatggtgctaaaagacaagtccattgaccagtctggtggagcccttcatggttaccaattagccaatcatgttacgaccttagctagcgtgggtaaacaatgtggagtaattttttacatacctgcagcttttacttcgaagattgatcccaccacgggctttgctgatttattcgctctctctaatgtgaagaatgtcgcttctatgagagagttcttctccaaaatgaagtcagtaatatatgacaaggcggaaggcaaattcgcctttacatttgattatttggattataacgttaaaagcgaatgtggacgtaccttatggactgtgtatacagttggtgaacgcttcacctactctagagtaaaccgagagtatgttcggaaagtcccaacagatatcatctatgatgcattacaaaaagctggtattagcgtcgaaggtgaccttagagatagaatcgcggaaagcgacggtgacacattaaagtctatattctacgcttttaaatacgcgttggatatgagagtcgaaaacagagaggaagactatatacagtcacctgtgaagaatgcttctggtgagttcttttgttcaaaaaacgccggaaagtctttgccgcaggattcagatgcaaatggtgcctataatatagctctgaaagggatcctacaactcagaatgttgagcgaacaatacgatccaaatgcagaatcgattagattgccacttataactaacaaggcatggttaacttttatgcaatccggtatgaaaacttggaagaattaa

SEQ ID NO: 132 - DNA, 3783 bp, Artificial Sequence
  Description of Artificial Sequence: Synthetic polynucleotide
atggattctcttaaggatttcactaatttatatccagtctcgaaaacattgcggttcgaattgaaaccagttgggaaaactctagaaaacattgaaaaagccggtatattgaaagaagatgaacacagagcggaatcctaccgccgggtaaaaaagataattgacacataccataaagtgtttattgacagctccttagagaacatggctaaaatggggatagaaaatgaaatcaaggctatgctgcagtctttttgtgaactctataagaaagaccacaggacagaaggagaagataaagctcttgataaaattagagctgttcttagaggtttaatcgttggggctttcactggtgtatgtggaagacgagaaaacacagtacaaaatgaaaagtacgagagtttgttcaaagaaaaattgataaaggaaattttgccagatttcgtgttgtccaccgaggctgagtctcttccattcagcgttgaagaagcaacaaggagcttaaaagagtttgactcattcacttcttattttgctggtttttacgaaaatagaaagaatatttattccacgaaaccgcaaagtactgcgatagcctacagattaattcatgaaaacttgcctaaatttatagataatattttggtcttccagaagattaaagaaccaatcgctaaagaacttgagcacataagagcagattttagcgcaggcggatatatcaaaaaagatgaacggctagaagacatattctcattaaattactacattcatgtcctttctcaagctggtatagaaaaatataatgctttaatcgggaagatagtgacggaaggtgatggtgaaatgaaaggtcttaatgaacatattaacttatataaccaacagaggggtcgagaggataggttgcccttgtttaggcctctatacaagcaaatcctgtccgatagagagcaattgtcttatttacctgaatcatttgaaaaagatgaagagctgcttagagcacttaaggaattttacgatcacatcgccgaagacatcttgggtagaacacagcaattgatgacttcaatttctgaatacgacttgtcccgtatttatgtcagaaatgattctcaacttacagacatctcgaagaaaatgctaggagattggaacgccatttatatggctagagaacgagcctacgaccacgaacaggctcctaaacgtattactgctaaatacgaacgtgatagaatcaaggccttaaaaggtgaagagtcaatttcattggcgaatctgaacagctgtatagctttcttggacaatgtaagggattgtcgagttgacacatacctatcaactttggggcagaaagagggtcctcatggcttaagtaacttggtggaaaacgtcttcgcctcatatcatgaagcagaacagttattgtcgtttccttaccccgaagagaacaaccttattcaggacaaagacaatgtagttttgatcaaaaacctattggataatataagtgatttacaacgtttccttaaacctttgtggggaatgggcgatgaacctgacaaagacgaaaggttttacggtgaatacaactatattagaggagcgcttgaccaggtaatacctttgtacaataaagtaaggaactacttgactcgtaaaccatattctactagaaaagttaaattgaactttggtaattcacagctgctgagtggttgggatcgtaataaagaaaaagataactcctgtgttatcttgcgaaaaggacaaaacttttacttggcaattatgaacaaccgtcacaaaaggtccttcgagaacaaagttctgcctgaatacaaagaaggtgaaccatattttgaaaaaatggactataaattcctgccagatcctaataaaatgttgcctaaggtcttcttgtctaaaaaaggtatagaaatatataaaccatccccgaagttgctggagcaatatggtcatggaacgcacaaaaaaggtgacacttttagtatggatgacttgcacgagttgattgatttttttaaacattccattgaagcgcacgaagattggaaacaatttggtttcaagttctctgacacagccacttacgaaaatgtatcgtccttttatagagaagtggaagatcagggttataaactgtcattccgtaaggttagtgaaagctatgtgtactcgttgatcgatcaagggaagctttatctttttcaaatctataataaagatttctctccttgttcaaagggcacacctaatcttcatacactatactggagaatgcttttcgatgaaagaaatttggctgatgtgatctataaattagacggtaaagctgagatttttttcagagagaaatccctgaaaaacgaccatccaactcatccggcaggtaaaccgattaaaaagaaatcccggcaaaaaaagggcgaagagagtttattcgagtatgatttagttaaggacagacattatacaatggacaaatttcaatttcatgtgcccattactatgaactttaagtgtagtgcagggtctaaggttaatgatatggtaaacgcacatattagagaagctaaagatatgcacgtcatcggtattgatcgcggagaaagaaatttactttacatttgcgttatcgattctaggggcaccatcttggatcaaatctctttgaacactataaatgatattgactatcatgatctactagagagtcgggataaagacaggcaacaagaaagaagaaattggcaaacaattgaaggtattaaagaattaaagcaaggctatctaagccaggctgtacacagaattgccgaattaatggtagcatataaagctgtcgtagctctagaagacttgaacatgggtttcaaaagagggcgccagaaggtcgaaagtagtgtttatcaacaatttgaaaaacagttaatagataagttgaattatctagtggataaaaaaaagcgtcctgaggacattggcggtttattaagagcctaccaattcactgcgccatttaaatcgttcaaagaaatgggtaaacaaaacggttttctattctacatccccgcatggaatacctcaaatatagatccaactaccggtttcgtcaacttatttcatgctcaatatgagaatgtggacaaagcaaaatcattctttcaaaaatttgatagcattagctacaatcctaaaaaagattggtttgaatttgcgttcgattataaaaatttcaccaagaaggctgaaggttccagatctatgtggatattgtgcacccacggaagtagaattaagaacttccgtaattcacagaaaaacggccagtgggacagcgaagaattcgccctaaccgaagctttcaaaagtcttttcgtaagatacgagatagactatacagctgatctaaagacagctattgtggatgagaagcaaaaagacttctttgtcgaccttcttaagttgttcaagttaactgtgcagatgagaaatagttggaaggaaaaagacctagattacttgattagcccagtcgctggtgcagatggcagattttttgatacacgtgaaggcaataaatcactaccaaaagacgcggacgctaatggcgcatacaacatcgcattgaagggtttgtgggctctcaggcagattaggcagacaagtgagggtggtaagcttaagctggcgatttctaataaggaatggttacagtttgttcaagaaagatcctacgaaaaagattaa

SEQ ID NO: 133 - DNA, 3792 bp, Artificial Sequence
  Description of Artificial Sequence: Synthetic polynucleotide
atgaacaatggtactaataattttcaaaacttcatagggatttctagccttcaaaagacattgagaaatgctttaattccaacagaaacgactcaacaattcatagtgaaaaatggtattataaaagaagacgagttgcgtggcgagaatagacaaattttgaaagatatcatggatgactactacagagggttcatctccgaaacattgtcttctattgacgacattgactggaccagcttattcgaaaaaatggaaatacagctgaagaacggagataacaaggacactcttataaaggagcaaacggaatatagaaaggctatacacaaaaagtttgctaatgacgatagatttaaaaacatgtttagtgcgaagttaatttctgatattctacccgagtttgtcattcataataataactactctgcatctgaaaaagaggagaagacccaggttataaagttgttttcaagatttgccacatcatttaaagactacttcaagaacagggcgaattgcttctctgctgatgatattagctcttccagctgtcatagaattgttaacgataatgccgaaattttttttagtaatgccttggtatatagacgcatagtcaagtcactaagcaatgatgatataaacaagattagtggtgatatgaaagatagccttaaagaaatgagccttgaagagatatattcatatgagaagtacggtgaatttataactcaagaaggaatttctttttataacgatatttgtggtaaggttaattcttttatgaatttgtattgccagaagaacaaggaaaataagaatctatataaactacaaaagttgcataaacagattttgtgtatagctgatacatcctacgaagttccgtataaatttgaatctgatgaggaagtttatcaatcggtaaacggttttcttgacaacatttccagcaaacatatcgttgagagactacgtaaaattggagacaactataatggttacaatctagataaaatatacatagtgtccaagttttatgagtctgtctctcaaaagacatatcgtgattgggagaccattaatactgcacttgaaattcattataacaacatattgcctggtaacgggaagagtaaagctgataaggttaaaaaggccgtcaaaaacgacttgcaaaagtctattaccgagataaatgaattagtgtcaaactacaaactatgctcagatgataatattaaagcggaaacatacatccacgaaatttcccacatactgaataactttgaagctcaggagcttaaatataacccggaaatacacttggttgagagcgagttaaaagcatctgagttgaaaaatgtattagacgtcatcatgaatgcgtttcattggtgttcagttttcatgactgaagaattagtcgacaaagataacaatttttatgccgaattagaggaaatatatgatgaaatttatcccgtaattagtttatacaatctagttagaaattatgttacacaaaagccgtatagtaccaagaaaataaagcttaatttcggaatacctacgcttgctgatggttggtcaaaaagtaaagaatatagcaataatgcaataattttaatgagagataacctatattatttgggtatttttaacgctaagaacaaaccagacaagaaaataattgaaggtaatacatctgaaaacaagggcgactataaaaagatgatatacaatttgctcccaggtcctaataaaatgattcctaaggttttcctgagtagcaagactggcgttgaaacttacaagcctagtgcgtatatcctggagggttataaacagaacaagcatatcaaatcctctaaggacttcgatatcaccttttgccatgacttaatcgattattttaaaaattgtatcgcaattcatccagaatggaaaaatttcggatttgattttagtgataccagcacttacgaggatatctctgggttctacagagaagtggagttgcagggctacaaaatcgattggacttacatatctgaaaaggacatagatttgctgcaggagaaaggtcagctatatttgtttcaaatctacaacaaagacttttctaaaaagtctaccggtaatgacaatctgcacacaatgtacttgaagaacttattctccgaggagaacttaaaggacattgtactcaagttgaatggagaagccgagattttttttagaaagagcagtataaagaatcctataatccacaagaagggctcaattctcgtgaataggacgtatgaggcagaagaaaaggaccaatttgggaatatacaaattgtaagaaaaaacatcccagaaaatatctaccaggaattatataagtattttaatgacaaatctgataaggaactgtctgacgaagccgctaagctcaagaatgttgtgggccaccatgaagctgctactaatatagtgaaggactacagatatacctacgataaatatttcctgcatatgccaattactataaacttcaaagcaaataaaacaggttttataaatgatagaatcctgcagtatattgctaaagaaaaggatttacatgtaattgggattgatagaggtgaacgcaatctgatctatgtcagcgtaatagatacttgtggtaatattgtggaacaaaagtcctttaatattgtgaacggatatgattaccaaatcaagttgaaacaacaagagggagcacgccaaattgcccgtaaggaatggaaagagataggtaagatcaaggaaattaaggaaggttatctttcattagttattcacgaaatttcgaagatggtaatcaaatacaacgcaataattgctatggaggacctgtcatatggatttaagaaaggtagattcaaggttgagagacaggtataccagaaatttgaaactatgttgatcaacaaattaaattacttagtctttaaggacatatcaataacggaaaacggcgggcttttaaaagggtatcaacttacatacatacctgataagttgaaaaatgtgggtcatcagtgtgggtgcatcttttatgttccagccgcttacacatcaaaaatcgatcctactactgggttcgtaaacatatttaaatttaaagatctaaccgttgatgcaaaaagagagtttatcaagaaatttgatagcattaggtacgattcagaaaaaaatctattctgttttacttttgactacaacaactttataacgcagaatacagtgatgtcaaaatcgtcctggtcagtgtatacttatggtgttagaattaagagacgtttcgtaaacggtcgtttttctaacgagtccgatacaatcgacatcactaaagatatggaaaaaactttggaaatgacagatataaactggagagatggtcacgaccttagacaagatataatcgattatgaaatcgtacagcatatttttgaaatttttcgcttaacagttcagatgcgtaactctcttagtgagctagaagatagagattatgatagacttatctcgcctgttcttaacgaaaataatatcttctatgactcggcaaaagccggtgatgcacttccaaaagatgctgatgcaaatggcgcgtactgcatcgcattgaaggggctctacgagattaaacaaatcaccgaaaactggaaagaagatggtaaattttctagggataagttgaaaatcagtaataaagattggttcgattttatacaaaataagcgatacttatag

SEQ ID NO: 134 - DNA, 3957 bp, Artificial Sequence
  Description of Artificial Sequence: Synthetic polynucleotide
atgaccaataagtttactaatcaatactcattgtctaaaacgttaagattcgagttaattccccagggaaagacactagaatttattcaagaaaaaggtcttctctctcaggataaacaaagagcagaatcataccaggagatgaaaaaaaccatagataaatttcataagtacttcatcgacttggcactatcgaacgccaagctaacacatttggaaacctacctggagttgtataataaatcggcagagacgaaaaaggaacaaaaattcaaggatgacctgaagaaggttcaagataatctgcgaaaggaaatagtgaagtcgtttagtgatggtgatgcaaagtcaatctttgctattttagacaagaaggaattaataaccgtggaacttgaaaagtggtttgaaaataacgaacagaaagatatttacttcgacgaaaaatttaaaacgtttactacgtactttacagggttccatcagaaccgcaaaaacatgtactccgttgaaccaaactctactgcaatcgcctacagattaatacacgaaaatttgcctaagtttttagaaaatgcaaaggcttttgaaaagataaagcaagtcgaatcgttacaggtaaactttcgcgaattaatgggcgaatttggagatgaaggtcttatttttgtcaatgaattagaggaaatgtttcaaattaattattataacgatgtcttgagtcagaacggcattactatctacaactcaattatcagtggtttcactaagaatgatataaaatataaaggtttgaatgaatacattaataattataatcaaactaaagataagaaggacaggcttccgaaattgaagcaattgtacaagcagattctaagtgataggattagtttgtctttcttgccagacgcatttactgatggcaagcaagtcttaaaggctatattcgatttctacaagattaacctactttcgtacacaattgaaggtcaagaagaatctcaaaatctgctgcttttgattaggcaaactatagaaaatttgtcgtcctttgacactcaaaaaatttacctgaagaatgatacacacctgactacaatatcacagcaggtctttggggatttttctgtcttctccacggccctaaactattggtatgagacaaaagttaatccaaaatttgaaacagaatatagtaaggcgaatgaaaaaaagagagaaattttggataaagcgaaggcagtattcacaaaacaagactatttttctatcgcatttctccaagaagtcttatccgaatatattttgacactcgatcacacctctgatatagttaagaaacattcgtccaactgcatcgcagattacttcaagaatcacttcgtggctaagaaagaaaacgaaacggataaaacttttgacttcattgctaacataaccgctaaataccaatgtattcagggcatattagaaaatgcagaccagtacgaagacgagttaaaacaggaccaaaagttaatagataatctaaagtttttcttagatgctatacttgagttattacattttataaagccattgcatctaaaatcggaaagtattactgaaaaagacactgcgttctatgatgtgttcgaaaattattatgaggctttatctttattgacccccctttacaacatggtccgcaattatgttactcagaagccttactctactgaaaagatcaaattaaactttgaaaatgctcagttgctgaatggttgggatgccaataaggaaggtgactacctgacgactattctaaaaaaagacggtaattatttcttagcaatcatggataaaaaacataacaaggcatttcaaaaatttccagaaggaaaagaaaactatgaaaagatggtttataaattgttgcctggagttaataaaatgttgccaaaagttttttttagcaataagaacatagcttactttaatccatctaaggaactgctcgagaactacaagaaggaaacacataaaaaaggtgatacatttaatttggaacattgccatactctgattgatttttttaaggactctcttaataaacatgaagactggaaatattttgattttcaattttcggaaactaaatcataccaagatctaagtggattttacagagaagttgaacaccaaggttataagattaacttcaagaatatagattctgaatacattgatggtcttgtaaacgagggtaaactattcctgttccaaatctactctaaggacttctcacctttttccaaaggaaaacctaatatgcatacgttgtactggaaggctctatttgaagaacaaaatttgcaaaatgtaatctacaaactgaacggccaagctgaaatattcttcagaaaagcctcaattaagccaaaaaacattattcttcataaaaagaagatcaagattgcgaagaaacattttattgataagaagaccaagacttccgaaattgtaccagtacaaacaatcaagaatctcaatatgtattatcaaggcaagataagtgagaaagagttaacccaggatgatttacgttatatagacaatttctctatattcaacgagaagaacaaaacaatagacattatcaaagataaaaggtttactgttgacaaatttcaatttcatgtgcctatcacaatgaactttaaggccacaggtggttcgtacattaatcaaactgttttagaatatctgcaaaataacccagaggtcaagatcatcggtcttgataggggtgagagacatctggtgtatctaacactcattgatcaacaaggcaacatcttgaagcaagaatcattgaacactatcacagactccaagatctcgactccatatcacaaactccttgacaataaagaaaacgaaagggatcttgccagaaaaaattggggtacagttgaaaatattaaggaactaaaagaaggttacatttcgcaagtagttcacaagattgcaacactcatgttggaagaaaacgcaatcgttgtcatggaagatttaaatttcggatttaagagaggaagatttaaagtagaaaagcaaatctaccagaagttggagaagatgttaattgacaaattgaactacttagtgctgaaagacaaacagcctcaagaattgggcggtctatacaacgctttacaactgacaaataaatttgagtcattccaaaagatgggtaagcagagtggttttttgttttatgttccggcatggaacacatccaaaatcgatccaactacaggcttcgtgaattatttctacactaaatatgaaaatgtggataaagcaaaagctttctttgagaagttcgaggcgatccgttttaacgctgaaaagaagtacttcgagttcgaggtcaaaaagtattcagattttaaccccaaggctgaaggcacccagcaagcatggactatttgcacgtacggtgagcgaatcgaaactaaaaggcaaaaggatcaaaataataagtttgtaagcacacccattaacttgacagaaaagatagaagattttcttggaaaaaaccaaattgtatatggtgacggtaactgtatcaagtcacaaattgcttctaaagacgataaggccttcttcgaaactctgctatactggtttaaaatgacgttgcaaatgagaaacagtgaaactagaactgatatcgactatttaatatcacccgtgatgaacgataatggtaccttttacaattcaagagattacgagaaattggagaaccccacactaccaaaagacgcagacgctaatggtgcctaccatattgctaaaaagggactgatgttgttgaacaagatagatcaagccgacttaactaaaaaagttgatttgtcaatttcgaatagagattggttgcaattcgtccagaaaaataagtaa

SEQ ID NO: 135 - DNA, 4017 bp, Artificial Sequence
  Description of Artificial Sequence: Synthetic polynucleotide
atggaacaggaatactacttgggtttggatatgggaactggttcagtcggttgggctgttacggactccgagtaccacgtgttgagaaaacacggaaaggctttatggggtgtcagactattcgaatcagcatcgaccgcggaagagagaagaatgtttagaacttcaagaagaaggctggatcgtaggaattggcggatagaaattttacaagaaatattcgccgaagaaatctctaaaaaagatccaggattttttctacgtatgaaggaatccaaatactatccggaagataaacgtgatattaatggcaattgtccagagttaccctatgctttatttgtggacgacgatttcaccgataaagattaccataagaagttcccaacaatttaccatctgagaaagatgttaatgaacactgaagaaaccccggatataagactggtctatctagccattcatcatatgatgaaacacaggggacacttcttgctatcaggggatataaatgaaattaaagaatttggtacaacattttctaaattattggaaaatattaaaaacgaagaattagattggaatttagaattaggcaaggaggaatacgcagttgtcgaatcgattctgaaagataacatgttgaacagatcaacgaaaaaaacaaggctgatcaaggctttaaaagcgaaatcaatatgcgaaaaagcagtattgaatttgttagctggggggactgtcaagttgtctgatattttcggattggaagaattgaatgaaacagagagaccgaagatatccttcgccgataatggctacgatgattatataggcgaagtcgaaaatgagctgggcgaacaattctacattatcgagactgccaaggctgtttatgattgggcggtgttagtcgaaatccttggcaaatacacttccatctccgaagctaaggtggcaacctacgaaaagcataaaagtgatttgcaattccttaagaaaattgtccgaaagtacttgaccaaagaagagtacaaggatattttcgtatcaacatcggacaaactgaagaattattcagcttatattggcatgacgaaaattaatggtaagaaagttgatttgcaatccaagagatgttctaaagaagaattttacgatttcattaaaaaaaatgtcctaaaaaagttggagggacaacctgaatatgagtatttaaaggaagaactggaaagagaaactttcctaccaaagcaagttaatcgtgataatggcgttattccataccaaatacacttgtacgaattaaagaagatcttgggtaacttgagggacaaaattgatttaatcaaggaaaatgaagacaaactggtacaattatttgaatttagaataccttactacgtgggccctttaaacaaaatagacgatggtaaggaagggaagttcacatgggcagtcagaaagtccaatgaaaaaatttacccatggaatttcgaaaacgttgtagatattgaagcttctgctgagaaatttattaggagaatgacaaataaatgcacttatcttatgggggaagacgtgttgcctaaagatagtttattatattcaaagtatatggtcttaaatgaattaaacaatgttaaattagatggtgaaaaactttccgtcgaattgaaacaaagattgtatacagatgtattctgcaaatatagaaaagtaactgtaaagaagattaaaaactaccttaaatgtgaaggcattatcagcggaaatgttgagatcactggtatcgatggtgattttaaggcatctttaaccgcatatcacgactttaaggaaatattgacgggtactgagcttgctaaaaaagacaaagagaacattatcaccaatatcgtgctcttcggagacgacaagaaattattgaaaaagagattgaaccgcctataccctcagattacccctaaccaattgaagaaaatctgcgctctgtcttatactggatggggtcgttttagcaagaagtttctagaagaaattactgctccggatcctgaaactggggaagtctggaatataattaccgcgctatgggaatcgaataataatttaatgcaattactatctaatgaatacagatttatggaagaagtcgaaacttacaatatgggaaaacaaacaaaaactttgagctacgaaacagtagagaatatgtatgtctcaccatctgtaaagcggcagatctggcaaaccttgaagatagttaaagaattagaaaaagtgatgaaggaaagtccaaaaagggtttttattgaaatggcccgagaaaaacaagaatctaaaaggacggaaagtaggaaaaagcaacttatagatctatataaagcctgcaaaaatgaagaaaaagattgggtaaaggaattaggtgaccaggaagagcaaaaattgagatctgacaagctgtacttgtattatacgcaaaagggccggtgtatgtattcgggtgaggtaatagaattgaaagatttatgggataacactaagtatgacattgaccatatttacccccagtctaagacaatggacgattcattaaataaccgagttcttgtcaaaaagaagtacaatgccacaaagagcgataagtacccattgaacgaaaatataagacatgaacgaaaaggtttctggaaatcattgttggacggtggatttatttccaaagaaaaatacgagagattgattagaaacactgaactatctccagaggagttagctggctttatcgaaagacaaattgttgaaactagacagtctacaaaagcagttgcagaaatcttaaaacaagtatttccagaatccgaaattgtgtacgtcaaagccggaacagtaagtagatttagaaaagactttgaattattgaaagtacgagaggttaacgacctacatcatgctaaggatgcttatttaaatatagtcgttggtaattcgtattacgtgaaattcacaaaaaacgcatcttggttcatcaaggagaatcctggtaggacatacaacttgaaaaagatgtttacatcaggatggaatatcgaaagaaatggtgaggttgcgtgggaggtaggcaagaagggaaccattgttactgtaaagcaaattatgaataaaaacaatatacttgttacgagacaggtgcacgaagccaaaggagggttgtttgaccagcaaatcatgaagaaaggtaaaggtcagatagcaataaaagagactgatgagcgtttagctagtatagaaaaatatgggggctacaataaggcagctggtgcttacttcatgttggtcgaatcaaaggataaaaaagggaagacgatccggaccatagagtttatccctctgtacttgaagaataagattgagtctgacgaaagcatcgcattgaatttcttggaaaaggggcgcggtctaaaggagccaaaaatattgttaaagaaaattaaaatagacaccctattcgacgtcgatgggtttaagatgtggcttagtggtcgtactggggacagattattattcaagtgtgccaatcagttaatccttgacgagaaaatcattgttacaatgaaaaaaattgttaagtttattcaaaggcgacaagaaaatagagaactaaagttgagtgataaggatggaatcgataatgaagtgttaatggagatttataacacttttgtcgacaaattggagaatacggtgtacagaattaggctatctgaacaggctaaaaccctaattgataaacagaaggagtttgagcgactttctcttgaagacaaatcttcaactcttttcgagatcctacatatctttcagtgtcaatcttctgcagctaatttgaaaatgattggaggtcctggtaaggctggtatattagtcatgaacaacaacatatctaagtgtaataagattagtataattaaccaatcaccgacaggtatctttgaaaatgaaattgatttacttaaa

SEQ ID NO: 136 - DNA, 3858 bp, Artificial Sequence
  Description of Artificial Sequence: Synthetic polynucleotide
atgaaatcattcgactcgttcaccaacttgtactccctgtctaaaacattgaaatttgaaatgcgacctgttggtaacacccaaaagatgttagataatgcaggagttttcgaaaaggataaactgatccagaaaaaatacggtaaaacgaaaccatatttcgataggttgcatcgggaatttatagaagaagctttgactggtgtagaattaattggcttagatgagaatttccgtactctagtcgattggcaaaaagataaaaagaacaatgttgccatgaaggcatacgaaaatagtctacaaagactaagaacagagatcgggaaaattttcaatttgaaggcagaagactgggtgaagaacaaatatccaatattgggtcttaagaataagaatactgatatattgttcgaggaggccgttttcggtattcttaaggcaagatatggtgaagagaaagacacgtttattgaagttgaggagattgataaaaccggtaagtccaaaatcaaccagatctctatcttcgacagttggaagggcttcactggttattttaagaagttcttcgaaactaggaagaacttctataaaaacgatggtacttccacggctattgctacaagaattatcgaccaaaaccttaagcgttttattgataacctatcaattgttgaaagtgttcgacagaaagtagatttggctgaaactgaaaaatcttttagtatctccttatcccagtttttctctatagatttttataataaatgtttgctgcaagatggcattgactactataataaaataattggtggagagacattgaaaaacggagagaagctgattggccttaatgagttgataaatcaatatagacaaaataataaggaccagaaaatccctttctttaaattgctagacaaacagattttgtctgaaaagatcctattcttggatgaaataaagaacgatactgaattgattgaagctttgtcccagtttgctaaaacagctgaagaaaagacaaagattgtgaaaaaattgtttgctgatttcgtagaaaacaattctaaatatgatctagcccagatttatataagtcaagaagctttcaatacaataagtaataagtggacaagtgaaacagaaacttttgctaagtatttattcgaagccatgaagtctggtaaacttgccaaatacgaaaaaaaagataacagttataaatttccagactttatagccctttcacagatgaagtctgccttattgtcgatatccttagaaggtcatttttggaaggaaaaatattataagataagcaagttccaagaaaagactaattgggaacaatttttggctatatttctatatgagttcaattcattattttccgataaaatcaacactaaggatggagagactaagcaagttggctactatttgttcgcaaaagatctgcacaatttgattctatcagaacaaatagatataccaaaagattcaaaggtaactataaaggatttcgcagattccgtcctcaccatttatcaaatggctaaatattttgccgttgaaaaaaagagagcgtggttagcagaatacgagttggactcgttttatactcagccagatactggatacttgcaattctacgataatgcatacgaagacattgtacaggtatacaataaacttagaaattacttaaccaagaagccctacagtgaagaaaaatggaagctgaactttgaaaattcgactttggcaaatggttgggataaaaataaagaaagtgacaactccgcagtgattttgcaaaagggtgggaaatattacttgggtttaatcacaaaaggccacaataagatttttgatgatagatttcaagaaaaattcatagttggtatagaaggtggcaaatacgagaaaattgtctataaattcttccctgatcaagccaaaatgttcccaaaagtttgcttttctgctaaaggattggagtttttccggcctagcgaggagatccttcgtatctacaacaatgctgaattcaaaaaaggagaaacctatagcatagattctatgcaaaaactgatagatttttataaggattgtttaacaaagtacgaaggctgggcctgctatacatttagacatttaaagcccacagaagaataccaaaataacattggtgaattctttcgggacgttgccgaagacggctataggatcgattttcaaggtatctcagatcaatatatccacgaaaagaacgagaagggtgagctgcaccttttcgaaattcataataaggactggaatttggataaggcgagagatggtaaatcgaagaccactcaaaagaacttgcatactttatattttgagtccttgttttctaatgataacgtcgtccaaaattttccaataaagttgaatggacaagcggaaattttctatcggcctaagacagagaaagacaaattagaatcaaagaaagataaaaagggaaataaagtcattgatcacaaacgatactctgagaataaaatatttttccacgtaccattgacactcaacaggactaagaatgactcttatagatttaatgctcagattaataattttttggcaaataacaaggatattaacataattggggtggatagaggtgaaaagcacttggtatattactctgtcatcactcaggcttctgatatattggaaagcgggtctctaaatgaattgaacggtgttaactacgccgaaaagctaggtaaaaaagctgaaaacagagagcaggctcggcgcgattggcaagatgttcaaggaattaaagaccttaaaaaaggctacattagtcaagtagttagaaagttagccgatcttgctattaaacataacgcaatcattattctggaggacctaaatatgcgttttaagcaagttaggggtggcatagaaaaaagtatttatcagcagcttgagaaggctttgatagataagttatcgttcctagttgacaaaggtgaaaaaaatcctgaacaagctggtcatctgttgaaagcttatcagctgagcgcaccttttgaaacatttcaaaaaatgggaaaacaaacaggtattattttctatactcaagcgagttatacaagtaaatctgacccagtgacaggatggagaccacacctttatctaaaatatttttctgctaaaaaggccaaagatgacatcgctaagtttacaaaaatagaatttgtcaacgatagatttgaattgacttacgatattaaagattttcagcaagcaaaagaatacccaaataagacagtgtggaaagtatgctccaatgtggagagatttagatgggataaaaatctcaatcaaaacaagggtggttacacacattatactaatataactgaaaatattcaagaattgtttactaagtacggaattgacataaccaaagacttactaactcagatttcaactattgacgaaaaacaaaatacctcatttttccgcgactttattttttatttcaacttgatctgtcaaattcgtaacacggatgattccgaaattgccaagaagaacggaaaagatgatttcatcctatctccagtggaaccattttttgactcaagaaaagataatggtaataagttgcctgagaacggagatgataacggcgcttataatatcgctcggaagggtattgtaattcttaataaaatatctcagtactctgaaaagaacgaaaactgcgagaaaatgaagtggggcgacttgtatgtatctaatatagattgggataatttcgttactcaagccaacgcgagacattga

SEQ ID NO: 137 - DNA, 3465 bp, Artificial Sequence
  Description of Artificial Sequence: Synthetic polynucleotide
atggaaaattttaaaaacctatatccaattaataagacacttagattcgagcttaggccatacggcaaaacactagaaaattttaagaagtcaggcctattagaaaaagacgcctttaaggcaaattccagaagatcaatgcaggcaattattgatgagaaatttaaagagactatcgaggaaaggttgaaatacactgaattctctgagtgcgatctgggaaacatgacttccaaggataaaaagattaccgataaggctgctaccaacctcaaaaagcaagtcatcttatcgtttgatgatgaaatttttaataactacttaaagccggacaaaaacattgacgccctattcaaaaatgatccgtccaaccccgtaatttcaacttttaagggttttaccacgtactttgtaaatttttttgagattcgtaaacatatcttcaaaggagaatcgtcgggttccatggcctataggataattgatgaaaatcttacgacttacttaaacaatatcgaaaagataaaaaagttaccagaagaattaaagtctcaattggaaggtattgaccaaatagacaaattaaataactataatgagttcataactcaaagcggtatcacacattacaatgaaattatcggtggtatatctaaaagtgagaacgtaaaaatacagggaataaacgaggggatcaatctatactgtcagaagaataaagtaaaattaccaagactaacgccattatacaaaatgattctgtctgatagagtttccaactcgttcgtgcttgatactatagaaaatgatactgaattaattgagatgattagcgacttgattaataaaacagaaatatctcaagacgtaataatgtcagacattcagaacattttcataaaatataaacagcttggtaatttaccggggataagttactctagcatcgtgaatgctatttgctccgattatgacaataattttggtgacggaaaaagaaaaaaatcatatgagaacgataggaagaaacaccttgaaacaaacgtatactcaattaactatatatcggaactgttaacagacaccgatgtatcatctaatataaaaatgagatataaggaacttgaacaaaattaccaggtgtgtaaggagaatttcaatgctaccaactggatgaacattaagaatattaaacagagtgaaaagacaaacttgattaaagatctactagatatactgaaatcaatacagagattctacgatctgtttgatatagttgatgaagacaaaaatcctagtgctgagttttacacgtggctaagtaaaaatgcggaaaagttagatttcgagttcaactctgtttataataaatctaggaattatttaactagaaagcagtattctgataaaaagataaaattgaacttcgactcccctacgttggcaaagggttgggatgcaaacaaagaaatcgataactccaccataataatgcgtaagtttaacaatgataggggggattacgattattttttgggaatttggaacaaatctaccccagcgaatgaaaaaattattccccttgaagacaatggtctttttgaaaaaatgcagtataaattatatccagacccatccaagatgcttccaaagcaatttctgtcaaaaatttggaaggctaaacaccctactactcctgaatttgataagaagtataaggagggccgacacaaaaagggtccagattttgaaaaagaattcctgcatgaattgatagattgttttaagcatggtttggtaaatcatgatgaaaaatatcaggatgtctttggattcaatttgagaaatacagaggattacaactcatatacagaatttctcgaggacgtcgaacgttgcaattataatctcagtttcaacaagatcgcagacacttcaaacttaattaacgacggaaaattgtacgtttttcaaatctggtcgaaagactttagtattgattcaaagggtacaaaaaacctaaatacaatatatttcgaaagtctattctcggaagaaaacatgatcgaaaaaatgttcaaactgtcaggcgaagctgaaatattctaccgtcccgcaagccttaattattgtgaggatatcattaaaaaaggacatcaccatgcagagttaaaagataaattcgattacccaataattaaagataaaagatactcccaggataagttctttttccatgtacctatggttattaactacaagtcggaaaaactaaactcgaagtcattaaataatagaactaacgagaacttgggacaattcacacatataattggtattgatcgtggcgaaagacatttaatatatctgactgttgttgatgtttcaacaggagaaattgttgaacagaaacatcttgatgaaattataaacacagatacaaaaggcgttgagcataaaactcattatctaaataaattggaggaaaagtcgaagactcgcgataacgagagaaagagttgggaagcaattgaaaccataaaagagcttaaagaaggttacattagtcacgtcatcaatgaaatacaaaagttacaagaaaagtataacgctttgattgtaatggaaaatctaaattatggttttaagaattcaagaatcaaagtcgaaaagcaggtctatcagaaatttgaaacggcacttattaaaaagtttaactacattattgataaaaaggacccagaaacttatattcatggttaccaactgacgaacccaatcacaacattggacaaaattggaaaccaaagtggaattgttttatacattccagcttggaatacatccaaaatagaccctgtcacggggtttgtcaacttgttatatgccgacgatttaaagtataaaaaccaagaacaagcaaagtcttttattcaaaagattgataatatttatttcgaaaacggtgaatttaaattcgacatagatttttctaaatggaacaaccgttattcaataagtaaaactaaatggacactcacctcatacggcactcgtatccaaacctttcggaatccccaaaaaaataacaaatgggattctgcagaatacgacttgaccgaggaatttaaattaattcttaatatagacggtacactcaaaagtcaagacgtggagacatacaagaagtttatgtcgttattcaagcttatgcttcagttgaggaactccgttacaggcactgatattgattacatgatttcaccagtaacggataagactgggactcatttcgattctagggaaaatattaaaaatttacctgctgacgcagacgcaaacggcgcatacaatatagcaagaaaagggattatggccattgagaatattatgaatggcatatcagatccattaaagataagcaatgaagactacttaaaatacattcagaatcagcaagaataa

SEQ ID NO: 138 - DNA, 3924 bp, Artificial Sequence
  Description of Artificial Sequence: Synthetic polynucleotide
atgacccagtttgaaggtttcaccaatttgtaccaagtaagtaaaaccttgaggttcgaattgatcccacagggcaagacattgaagcatattcaagagcaaggatttatagaagaagataaagcgagaaacgatcactataaagagttaaaacccattattgacaggatctataaaacatacgccgatcaatgccttcaattagtgcaattagattgggaaaacttgagcgctgccatcgattcctacaggaaggaaaaaacagaagaaacaagaaatgccttaatcgaggaacaagcaacctatagaaacgctatacacgattacttcatcggtagaactgataatctaacagatgcaataaataagagacatgctgagatatataaaggactatttaaagcagaattattcaacggaaaggtgttgaaacagttaggtaccgttacaactactgagcatgaaaatgccttgctgagaagctttgacaagtttactacctacttttcgggtttctacgaaaatcgcaaaaatgtattttctgcggaagatatttcaactgcaatccctcataggattgttcaagataatttccctaagtttaaagagaactgtcacatttttacaaggttaattactgcggttccaagtctaagagaacattttgagaatgtaaaaaaagcgattggtatatttgtatccactagcattgaagaggttttcagcttccctttttataaccaattacttacccaaacacagatcgacctgtacaaccaattgttaggtggtatatcgagggaggctggtacggaaaagattaaaggattaaatgaagttcttaatttggccatacaaaaaaatgatgaaaccgcgcacattatcgcatctttaccacataggtttataccgttattcaagcaaatattatctgatcgtaataccttatcgttcatattagaggagtttaaatctgacgaagaagttatacaatctttttgcaagtataagacgctattgagaaacgaaaacgttctggaaacagccgaagcactgttcaatgaattaaacagtatcgacttgactcatatttttatatcgcataaaaagttggagacaatttcttcagcattgtgcgatcactgggacactttaaggaacgcactatatgaacgtaggatctcagaattgacaggtaagataacgaagtctgctaaagagaaagtgcagagatccctaaaacacgaggatataaatttgcaggagataatttcagctgcaggtaaagagttgtctgaagcgttcaagcaaaagacttccgaaatcttgtcacacgcacacgccgcattagatcaacctttacccactactttgaaaaaacaagaagagaaggagatattaaaatcacaacttgattctttacttggcctttatcatcttttagattggttcgctgttgacgagagcaatgaagtggatccagagttttccgcaagattgaccggtataaagttggaaatggaaccttcgttatcattttacaacaaagctaggaactatgctacaaaaaaaccttattctgtcgaaaaatttaaactgaacttccaaatgcctactctagcaagtggctgggatgttaataaagaaaagaacaatggcgctattttgtttgtaaaaaatggcctatactatcttggaattatgcctaaacaaaaaggtcgctacaaggctttgtcatttgaacctactgaaaagactagcgaaggtttcgataagatgtattacgattatttcccggatgccgctaaaatgatccccaagtgctctactcaattgaaggcagtaactgctcatttccaaacgcataccacgccaatactgctttctaacaactttatagaaccactagaaataacgaaagaaatttacgacctaaataacccagagaaagaaccaaaaaagttccagacggcctacgccaaaaagacaggggaccaaaaaggttaccgcgaggcgttatgtaaatggattgattttactagggactttttatcaaaatacactaaaacgacgtctattgatcttagctccttacgcccgtcctcccaatacaaggatctaggtgagtattacgcagagttgaacccgctattataccatatttccttccaaaggattgctgaaaaggaaattatggacgctgttgaaactgggaaattgtacctgtttcagatttataataaggacttcgcaaagggtcaccatggtaagcctaaccttcacactttgtactggaccggactattctcgcctgaaaatttggctaaaacaagtatcaagttaaacggtcaggccgagttattttatagacccaaatctagaatgaaaagaatggcccatagattaggcgaaaagatgttaaacaagaaattaaaggaccaaaaaaccccgataccagacactctataccaagaactgtacgactatgtgaatcacaggcttagtcacgatttatcagatgaagcgagggctttattgccaaatgtcatcaccaaggaagtatcacatgaaataattaaggatagaaggttcacatctgataaattcttttttcatgtcccaattacattgaattatcaagcagcgaactcaccatctaaatttaatcagcgcgtcaacgcctatttgaaagaacatcccgaaacaccaatcatcggcatagatcgaggtgagagaaacttaatatatataactgtgattgattctacaggaaaaatcctggagcaacgatctttaaataccatacaacagtttgattatcaaaaaaagttggataacagagaaaaagaacgtgttgccgctaggcaggcttggtctgtggtaggaacaattaaggacttaaagcagggctatctgtcccaagttattcatgaaatagtcgatctgatgatacattatcaggcagttgtcgtgttggaaaatttgaattttggctttaaatcaaaaagaactggcatagcagaaaaagctgtgtaccagcagtttgaaaagatgttaatcgataagctaaactgccttgttcttaaagattaccccgcagaaaaagtaggtggtgttcttaatccatatcagttgacagaccaatttacatcctttgcgaaaatgggtacgcaaagcgggttcttattctacgtaccggccccctatacttctaagatcgacccactaacaggttttgtggacccttttgtttggaagacgataaagaaccacgagtcacgcaaacatttcttagagggctttgatttcttgcactacgacgtgaaaactggtgattttatcttacactttaaaatgaacagaaatctctctttccaacgtggactgcccggattcatgccggcttgggacatcgtttttgaaaagaatgaaacgcagtttgacgccaaaggtacaccatttatagcgggtaagagaattgtgccggtcatagaaaaccatagatttacaggtagatatagggatctgtaccctgctaatgaattgattgcattactcgaagagaaaggaattgtgtttcgagatggatcgaatattttacctaagttgttggaaaatgatgattcacacgcaattgatactatggttgccctcataagatcggtattgcaaatgagaaactcaaatgctgctacgggagaggattatataaacagccccgttcgcgatcttaatggtgtttgttttgattcacgttttcagaaccccgaatggccaatggatgccgacgcaaacggagcatatcatattgctcttaaaggccaactactattaaatcacttaaaggaatccaaagacctaaaattgcaaaacgggatatctaatcaggattggctggcttacatacaagaactacgtaactag

SEQ ID NO: 139 - DNA, 3390 bp, Artificial Sequence
  Description of Artificial Sequence: Synthetic polynucleotide
atggccgttaagtcaatcaaagtgaaacttagactggatgacatgccagagattcgtgcggggttatggaaacttcataaggaagttaacgcaggggtaagatattataccgaatggttatcattacttcgacaagagaatttgtacagaaggtccccgaacggcgacggtgagcaagaatgcgataagacggctgaagaatgtaaggcagaacttttggagcgcctgagagcccgtcaggttgaaaatggccatagaggtcctgcgggatctgatgatgagcttttacagctagctagacaattgtatgaattgttggtccctcaggctattggggctaaaggagacgctcaacaaatcgccagaaagttcttgtcacctctggctgacaaagatgccgtgggaggattaggtatcgctaaagcaggtaataaaccaagatgggttagaatgagagaagcaggcgaacctggttgggaagaagagaaagaaaaggccgaaactagaaaaagcgctgacagaaccgcagatgttttacgggccttggctgattttggactgaagcctttgatgagagtgtatactgattcagaaatgtcttccgttgaatggaagcccctaaggaagggacaagcggtcagaacctgggatagggatatgtttcaacaggctattgaaaggatgatgtcatgggaatcctggaatcaaagagtaggtcaagaatacgctaaactggtcgaacaaaagaatagatttgaacaaaaaaattttgtaggtcaagaacatttagtacatttggttaatcaacttcaacaagatatgaaagaggcatctcctggtttggaatcaaaagaacaaacagcacactatgttaccggccgagctttgcgaggttctgacaaagtatttgaaaagtgggggaaattagctcccgatgccccctttgatctatatgatgctgaaattaaaaacgttcaaagaaggaacactagacgttttggatcccatgatctttttgcaaagctagctgagccagaataccaggctctatggcgtgaagacgcctcgtttttgactagatacgcagtatacaattcaatactcagaaaactaaaccatgccaagatgtttgctacattcaccctgcccgatgctaccgctcatcctatttggactagatttgacaagttgggggggaatctacatcagtacacatttttatttaatgaattcggtgaaagaagacacgctattagattccacaagctcctaaaggttgaaaacggcgttgcgagagaagttgatgatgtaacagttcccatttctatgtcggagcaattggataatctattgcctagagaccctaatgaaccaattgctttgtactttcgtgactacggtgcagaacaacactttacaggtgaattcggcggagccaagattcaatgtagacgtgatcaactcgcacacatgcatagaagaagaggcgctcgtgatgtttatttaaatgtgtctgttagagttcaatcccaatcggaggctagaggtgaaagaaggccaccatacgcagcagtttttaggttagtaggtgataatcatagggcatttgtccacttcgacaaattaagtgattatttagcagagcaccctgatgatggaaagttgggcagtgagggattattaagtgggttgagggtaatgtctgtagatcttggtcttcgtacttctgcgagtatctctgtctttagagtagcacgtaaggatgagttgaaacctaatagcaaaggaagagtcccgtttttttttcctattaagggtaacgataacctggtggccgtgcatgaaagatcacaacttttgaaattgccaggagaaacggagtccaaggacttgagggcaattagagaggaacgtcagcgtacattgcgacagctgagaactcaattggcttatttgaggttgttggttaggtgtggttccgaggatgttggcagaagagaaaggtcttgggccaaattgatagaacaaccagtggacgccgcaaatcacatgacaccagattggagagaagctttcgaaaatgaactccagaaattaaagagcctacatggcatatgctctgataaagagtggatggatgccgtatacgaatccgttcgtagagtctggcgccacatgggtaagcaagtacgggactggagaaaggatgttcgttccggcgaaagaccgaagataagggggtatgcaaaggacgttgtaggcggtaattctattgaacagattgagtatttggaaaggcagtacaaatttcttaaatcctggagcttcttcggcaaagtgtcaggacaagtcatcagggctgaaaaaggttccagatttgctattacgctaagggaacatattgatcatgcgaaagaagatagactgaaaaaactagcagatagaataattatggaagcacttggttacgtctatgcacttgatgaaagaggcaaggggaaatgggtagctaaatacccgccttgtcaacttattttattagaagaattaagcgagtaccaatttaacaacgatagacctccatccgaaaataatcagctgatgcaatggtcccataggggtgtttttcaagaattgataaatcaagctcaagtacacgatttgctggtaggtactatgtacgcagcgttttcgagccgttttgatgcaagaactggtgccccaggtatcagatgtcgacgtgttccggccagatgtacacaggaacataaccctgagccatttccgtggtggcttaataagtttgttgtcgagcacacattagacgcatgccctctgagagcagatgaccttatacccactggagaaggcgaaatatttgttagtccattctctgcagaagaaggtgactttcaccagatacatgcagacttaaatgcagcacagaatctccaacaaaggttgtggtcggattttgatatttcgcaaataagactaagatgcgattggggagaggttgatggagaattggtgctgattccaagattaaccggaaagcgaactgccgattcctattctaacaaggtgttttacacaaatactggtgttacctattacgaaagagaaaggggtaagaagagacgtaaagtatttgctcaagaaaaattgtcagaagaggaggcagaactgttagtagaagcagacgaagccagagaaaaatcagttgtgcttatgcgtgacccttccggcattataaatcgtggtaattggacacgacaaaaagaattttggtctatggtcaatcaacgtatcgaaggctacctagttaagcaaatcaggtctagggttccactacaagatagcgcatgtgaaaatacgggtgatatataa

SEQ ID NO: 140 - DNA, 3327 bp, Artificial Sequence
  Description of Artificial Sequence: Synthetic polynucleotide
atggctactagatctttcattttaaaaattgaacctaatgaagaagtgaagaagggtctctggaaaactcacgaagtacttaatcatggcattgcctattatatgaatatcctgaagcttattcgtcaagaagctatatacgagcatcatgagcaagatcctaagaaccctaagaaagtaagcaaagcggaaattcaggctgaattgtgggacttcgtcttgaagatgcagaagtgtaacagttttacgcacgaagttgataaagatgtggtgtttaatattttgagggagctatatgaggagttggtgccctcgagtgtcgaaaaaaaaggagaagctaatcagctgtcaaataaatttttatatcctctggtggatccaaactctcaatcaggtaaaggcactgccagtagtggtcgaaaaccgagatggtataatttgaaaatcgcaggtgatccatcgtgggaagaagaaaaaaaaaaatgggaagaagataaaaaaaaagatccccttgccaaaatactaggtaagctagccgagtatggacttataccattattcattcctttcacggactctaatgaaccaattgtgaaggaaatcaaatggatggaaaaatcacgtaatcagtctgttaggaggttggacaaagatatgtttatacaggctcttgagaggtttttgtcgtgggagtcctggaatttgaaagtgaaagaagaatatgaaaaagtggaaaaggagcataagacgttggaagaaaggattaaggaagatattcaggcctttaagagtctggaacagtacgaaaaagaaagacaggaacagttattgagagatactctaaacactaatgaatataggctttccaagaggggcttgcgaggatggagagagataattcagaaatggttgaaaatggatgagaacgagccatcggagaaatatctagaggtgtttaaagattaccaaagaaagcaccctcgcgaagctggtgattactctgtttatgaattcctttcgaagaaggaaaatcacttcatctggcgaaatcatccagagtacccatatttatatgctacattttgcgaaattgacaagaaaaaaaaagatgctaaacagcaagcgacattcaccctcgctgatcccatcaaccacccattatgggtcaggttcgaagagagatcaggctcgaacctgaataagtacaggatcttgactgagcaattgcatactgagaagttaaaaaagaaattgacggtccaacttgacagattgatttatcccactgaatctggtggatgggaggagaaaggtaaggttgatattgtcctattgccttctcgtcaattttacaaccaaatatttctggacatcgaagagaagggtaaacatgcttttacctataaggatgagagtattaaatttccattgaagggaacgcttggcggcgctagagttcagttcgatagagatcatttgagaagatacccgcataaagtggaatctggtaatgtaggtcggatctactttaacatgacggtaaatattgaacctaccgagtcaccagtcagtaagtctttaaagattcatagggatgatttccctaaatttgtcaacttcaagcctaaggaactaaccgagtggatcaaagacagtaaaggcaaaaagttaaagagcggtattgagtccctggagataggtcttagagtcatgtctatcgatttgggtcaaagacaagcagccgcagcatctattttcgaagttgttgaccaaaaaccggatatcgaggggaaattattttttccaataaaaggaactgagctatacgctgtgcatcgcgcatccttcaatataaaactgccaggagaaacactagtaaaatctagagaggtcttgcgtaaagcacgtgaggacaatctcaaattaatgaatcagaagttaaatttccttaggaacgtgttgcatttccaacagttcgaggacataactgaacgcgagaaaagagtcactaagtggatctcaagacaagaaaatagtgatgtgccattagtgtatcaagacgaacttattcaaataagagagctaatgtataaaccatataaagactgggtggcattcttaaaacaattacacaagcggcttgaagtagaaataggaaaagaagtaaagcattggaggaagagtctgtccgatggtcgcaaaggcctgtacgggatatcacttaaaaatattgatgaaattgacagaacacgaaaatttttgttaagatggtcattgagaccaaccgaaccaggtgaggttagaaggttggaaccaggccaaaggtttgccatcgatcaattaaaccatcttaacgcactgaaagaagatagattgaagaagatggcgaacactattattatgcacgctctaggttattgctatgatgtgagaaagaaaaaatggcaagccaagaaccctgcatgccaaattattttgtttgaagatctttctaattacaatccatacgaagagcgttcacgttttgaaaactctaaattgatgaaatggtctagaagagagattccgagacaggtcgctctacaaggggagatttacggtcttcaagtcggtgaggttggtgctcaattttcttccagatttcatgcaaaaactgggtctccaggcattaggtgttcggtcgttactaaggaaaagttacaggacaaccgtttcttcaaaaatttgcaacgtgaaggccgtttaacacttgataagatagctgtccttaaggaaggcgatctgtacccagataaaggtggtgagaaattcatatctttgagtaaagacaggaaactggttacaacacacgccgacattaacgcagctcagaacttgcaaaagagattctggacaaggacccacggcttctataaggtgtactgtaaagcttatcaagtagatggacaaacggtttatattcctgaatcaaaggaccagaaacaaaaaattatagaagaatttggtgaaggatactttatcttgaaggatggagtttatgagtggggcaatgcaggtaagttaaagataaagaaaggttcatcaaagcaatcaagtagcgaactggtcgattcggatattttaaaggatagctttgatctagctagtgaattgaagggagaaaagttaatgttatacagagatcccagtgggaatgtatttccatctgataagtggatggccgccggagtgttttttggcaaattagagagaatcttgatttctaaactgaccaatcaatactcaatttcgaccatcgaagacgactcttcaaaacaatccatgtga

SEQ ID NO: 141 - DNA, 3450 bp, Artificial Sequence
  Description of Artificial Sequence: Synthetic polynucleotide
atgcctactcgcaccatcaatctgaagttagttttggggaagaacccagaaaatgcgactctaagacgggcactattctctacacatagacttgtcaaccaagcgactaagagaattgaagaatttttactgttgtgtagaggagaagcttatcgtaccgtagataatgaaggtaaagaagctgagatcccacgccatgctgttcaagaagaggcgcttgcttttgcaaaagctgcacaacgacataacggctgtatctccacatatgaggaccaggaaatcttggatgtgcttagacaattgtatgaaagattagtacctagcgtcaatgaaaacaacgaggctggggatgcccaagccgctaacgcttgggtgagtccattaatgagtgcagagtccgaaggtggactatcggtctatgataaagtgttagacccgccgccagtatggatgaaactcaaagaagagaaagcgcctggttgggaagctgcttctcagatttggatacagtccgacgaaggtcaatcgctgctaaataaaccgggtagcccaccacgttggattagaaaacttagatctggtcaaccgtggcaagatgacttcgtttcagaccaaaaaaaaaagcaagatgaactaacgaaaggtaacgcaccactcataaaacaattgaaagagatgggcctcttgcctttagttaatcccttttttagacatttgttggatcccgagggtaagggtgtatccccatgggacagattggccgtaagggccgcggtggcgcacttcatctcttgggaaagttggaaccacagaacaagagctgagtataacagtttgaaactgcgaagagatgaatttgaggccgcatctgatgaattcaaggacgattttacattgctacgacaatatgaggctaagcgacatagtacgcttaagtcaattgccttagctgatgactctaacccgtaccgaattggtgtaaggtccttgagagcctggaatagggttagagaagaatggattgacaaaggcgcaaccgaggaacaaagggttaccatccttagtaagcttcaaacacaattacggggtaaattcggtgatccagacctatttaattggctagcccaagatagacacgtacacctgtggtccccgagagattccgtcacgcccctcgtaaggattaatgccgtcgacaaagtgcttagaagacgtaagccttatgcactgatgacttttgcacatccgagattccatccaagatggattctatacgaagcgcctggtggttctaacttgcgacaatacgctttagattgtactgaaaatgctctgcatattacacttccattactcgtcgacgacgcccatggtacatggattgagaaaaaaatccgcgtaccactcgctcctagtggacaaatacaagatttaactttagaaaaacttgaaaagaaaaaaaacagattatactatagatcaggattccaacaatttgctggattagccggtggtgctgaggtgttgtttcataggccgtatatggaacatgatgagagatcagaagaatctctgttggaaaggccaggcgctgtgtggttcaaattaaccttagatgttgctacccaagcaccacctaactggttagatggtaaaggcagagttaggacacctccagaagttcatcatttcaaaaccgctctgtcaaataaatctaaacatacgagaaccttgcaaccaggattgagagtcctttctgttgatttgggtatgagaacatttgcttcttgttctgttttcgaattgatcgaaggtaaacctgaaacaggtagagcattccctgttgctgacgaaagatcaatggatagtccaaataagttatgggccaagcacgagagaagctttaaactaactctgcctggagaaacaccgagcagaaaggaggaagaagagagaagcattgctagggcagagatttacgcgctgaaaagagatattcaaagactgaaatcactcctaagattaggtgaggaagataatgataatagaagagatgctttgttagagcaattctttaaaggatggggtgaagaggacgtagttcctggtcaagctttccctagaagcctctttcagggattaggcgctgcaccctttaggtcaacacccgaattgtggagacagcactgtcagacgtattacgacaaagcggaagcttgcctggcaaagcatatttccgactggaggaagagaactagacctcgtccgacttcgagagagatgtggtataagacaagatcttaccatggtggcaaaagtatttggatgctagaatacttagatgctgtccgcaaattactactttcatggtcgttaagaggtcgtacttacggagctattaatagacaagacaccgctcgttttggttccttagcttctagattgttgcatcatatcaactctttaaaggaagaccgcatcaaaaccggtgcagatagtattgtgcaggccgcaaggggctatattcctctcccacatggcaagggttgggaacagcgttatgaaccctgtcagttgatattatttgaagatctagctaggtacagatttcgtgtagacagacctcggagagagaattcgcaattgatgcagtggaatcatcgagctatagtagcagaaacgacgatgcaagctgaactatacggtcaaatagtcgaaaataccgctgctggtttctcctcaagatttcatgctgcaactggtgctcctggtgtcagatgtcgctttttgttagaacgagatttcgataatgacctaccaaagccgtacttactgagagaactaagttggatgttaggtaacacaaaggttgaatcagaggaagaaaaattgcgtcttctaagcgagaaaattagaccaggttcattagtcccttgggatgggggtgaacaattcgcgacattacacccgaaaagacaaactctttgtgtcattcacgcagatatgaacgctgctcaaaacctgcaacgcagatttttcggaaggtgtggggaagcctttcgccttgtgtgtcagccacatggtgatgatgttttgaggctagcgtctacaccaggtgcaagacttttgggtgcattacaacaactggaaaatggtcagggagctttcgaattagttcgtgatatgggtagcacatcacaaatgaatcgtttcgtcatgaagtcgttgggcaaaaaaaagatcaagccattacaagacaataacggggatgatgaactagaagacgtgctatctgttttacctgaagaagatgataccggacgaattactgtatttcgggactcttcgggtatattcttcccttgtaacgtttggatcccggcaaaacagttctggcctgcggtccgtgctatgatttggaaggttatggcatcacattcattgggttag

SEQ ID NO: 142 - DNA, 3759 bp, Artificial Sequence
  Description of Artificial Sequence: Synthetic polynucleotide
atgacaaagttaaggcatagacagaagaagttaactcacgattgggcggggtctaaaaagagagaagttctagggagcaatggtaaattacagaatccattgctaatgcccgtcaaaaaaggtcaggtgacagaatttcgaaaagcattttccgcatacgcccgagcaaccaaaggggaaatgacggatggcagaaaaaatatgtttactcactcatttgaaccattcaagaccaagccttcgttacatcagtgcgaactggctgacaaagcctaccagagcttgcattcatatttaccgggttctttggcgcattttcttttatctgcccatgcacttggttttaggatttttagcaaatcaggggaagccactgcattccaagcgtcctcaaagattgaagcttacgaaagcaagttagctagcgagcttgcttgtgttgatttgtctattcagaacttgactatttcaactttgttcaacgcattaacgacttccgtaagaggtaaaggtgaggagacatcggcagatccactgatagctagattttacaccttacttaccggtaaaccactaagcagagacactcagggcccagaacgagatttagccgaggtgataagcagaaaaattgcaagttcttttggaacttggaaggagatgactgccaatccacttcaatctcttcaattttttgaagaggagttgcatgcgctagatgcaaatgttagtttgtcacctgccttcgatgttctgattaagatgaacgacctgcagggtgacttgaagaacagaacgatagtttttgatccagatgctcctgtgtttgaatataatgctgaggatcctgctgacatcatcattaaactgacagctagatatgcgaaagaagcagtgattaaaaatcaaaatgtcgggaattatgttaagaacgctattacgacaactaacgcaaacggactaggttggttgctgaacaaaggcctttccttattgcctgtctccactgatgacgaactattggagtttattggggtcgagagatcccatcctagctgtcatgcgttgatagaacttatcgctcagttagaagcacctgaactgttcgaaaaaaatgttttttctgatactcgttccgaggttcaaggtatgatagattcagctgtaagcaatcatatcgccaggctgtcaagctctcgtaattcattgagcatggactcagaggaacttgagagattgataaaatcttttcaaattcatacaccacattgttcattatttataggggctcaatccttatctcaacaattggaaagcctacccgaagcattgcagtcaggagtgaacagtgctgatattctgctcggctcaacccaatacatgttgacaaattctttggtcgaggagtcaatcgctacgtatcagagaaccttaaatagaattaactacctgtccggcgttgcaggacagattaacggtgctattaagaggaaagctattgatggtgagaagatacatttacccgctgcttggtcagagttaatttctttaccctttattgggcaaccagtgattgatgttgaatcagatttagcccacttaaagaaccaataccagacattgtctaacgaatttgatacgctgatttccgcactgcaaaagaatttcgacttaaattttaataaagccttgcttaatcgaacacaacatttcgaggctatgtgtagatcaacaaaaaagaatgccctttctaagcctgagatcgttagttatagagatttgctagccaggttgacttcttgtctttataggggctctctagtcttgaggagggcgggtatagaagtactgaaaaagcacaagatatttgagtccaactctgaattaagagagcacgttcatgaaagaaaacacttcgtatttgtttctccgctcgatagaaaagccaagaagctcctacgtttgactgactctaggcctgatttattgcacgtaattgatgaaatactacaacatgataatttagagaacaaggatagagaatctttgtggttagttcgatctggttatttactggccggcctaccagaccaactctcctcttcctttataaatcttccaatcattactcaaaaaggcgatcgtcgcttgatagatctcattcaatacgaccaaattaatagagatgcttttgtgatgttggtaacttccgcttttaagtcgaacttaagtgggctgcagtacagagcaaacaaacaatcttttgtggttacgcgcactttgtcaccatatttgggatctaaattggtttatgtgcccaaagataaagattggctggtcccttcccaaatgttcgaggggagatttgcggacattttgcaatccgattatatggtgtggaaggacgctggaagattgtgtgttattgacacagctaagcatttgtctaacattaaaaaatctgtattctcaagtgaagaagtcctcgcgtttttaagagaattgccacaccgtacgtttatccaaactgaggtcaggggtttaggggtgaatgtggacggtattgcatttaataacggggatataccctctctgaagacgtttagcaattgcgtgcaagtcaaagtgagtcggacaaacactagtctggtccaaacattaaatagatggtttgaaggcggtaaggtctcgccgcctagcatccaatttgagagagcatattacaaaaaagatgatcaaatccacgaggacgctgcaaaaaggaagataaggtttcaaatgccagctacagagttggtacacgcgtcagacgacgcaggatggaccccctcctatttacttggtatcgatcccggtgaatatggtatgggtttgtcattggtctcaataaataatggcgaagttttagatagcggatttatacacataaattcattgataaatttcgcttctaagaaatcaaatcatcaaaccaaagttgttccgaggcagcaatacaagtcaccatacgccaactatctagaacaatctaaagattctgcagcaggagacatagctcatattttggatagacttatctacaagttgaacgccctacccgttttcgaagctctatctggcaatagtcaaagcgcagcggatcaggtttggacaaaagtcctcagcttctacacctggggagataatgatgcacaaaattcaattcgtaagcaacattggttcggtgcttcacactgggacattaaaggcatgttgaggcaaccgccaacagaaaaaaagcccaaaccatacattgcctttcccggttcacaagtttcttcttatggtaattctcaaaggtgttcatgttgtggacgtaacccaattgaacaattgcgcgaaatggcgaaggacacatccattaaggagttgaagattagaaattcagaaattcaattgttcgacggtactataaagttatttaatccagacccgtcaacggtcatagaaagaagaagacataatttagggccatcaagaattcctgtagctgatagaactttcaaaaatataagtccaagctcactagaattcaaagaactaataacgattgtgtcacggtctatacgtcattccccagaatttattgctaaaaaaagaggtataggtagtgagtacttttgtgcttatagtgattgtaattcctccttaaattcagaagcaaatgcggctgcgaacgttgcccaaaagttccaaaagcaattgtttttcgaattatag

SEQ ID NO: 143 - DNA, 3864 bp, Artificial Sequence
  Description of Artificial Sequence: Synthetic polynucleotide
atgaaaagaatcttgaactctttaaaggttgccgccctgcgtttgttatttagaggtaaaggatctgaacttgtcaagactgttaaataccctttggtctcgccggttcagggtgcagttgaggagttagctgaggcgatccgccatgataacctacatctgtttggtcaaaaagaaattgttgaccttatggaaaaggatgaaggtacgcaagtttactcagtggttgatttctggttagatacccttcgtttggggatgtttttcagtccatcagcaaacgcattaaaaatcacgctgggtaagtttaattctgatcaggttagcccttttaggaaagtgttagagcagtctccattcttcttggctggtaggctgaaggttgaaccggcagaacgtatattatctgtcgagatccgtaagattgggaagagggaaaacagagttgagaactatgctgctgacgtagaaacgtgttttataggccaattaagttcagatgagaaacagtcaatacaaaaattagctaatgatatctgggatagtaaagatcatgaagagcaaagaatgttaaaggcagatttcttcgctatccctttgattaaggatccaaaggctgtgaccgaagaggatcctgaaaatgaaactgctggtaaacaaaaacccttggagttgtgtgtctgccttgtcccagaactttacacaagaggattcgggtcaatagccgattttttggttcaacgcttaactcttttaagggataaaatgtctacagatactgcagaagattgtttagaatatgtcgggattgaggaggaaaaaggtaacggcatgaactcattgttgggaacgttcttaaagaatttgcaaggcgatggatttgagcagattttccaatttatgttagggagctatgtcggttggcaagggaaggaagatgttttaagagagagattagacttattggctgaaaaagtgaagaggttaccgaaaccaaaatttgctggcgaatggtctggtcataggatgttcttgcatggccaattgaagtcttggtcttcaaatttttttagactatttaacgagacaagggaacttctagagtctattaagtcagatatacagcatgccacaatgctaatatcatatgtagaagaaaaaggtggttatcatcctcaattacttagtcaatatagaaaacttatggaacaactaccagctttgcgtaccaaggtattggaccctgagattgaaatgacacatatgtccgaagcagttcgctcttatataatgatacataaatctgttgcgggttttttaccggatttattagaatcattagatagagacaaggatcgtgagtttctgcttagtatttttccaagaatcccaaaaattgataaaaaaaccaaggaaattgtagcttgggaactgccgggagaaccagaagaaggttatttatttactgctaataacttgttcagaaacttcttagagaatccgaaacatgtcccgagatttatggccgaaaggatcccagaagattggactcgattacgctctgctcctgtctggttcgatggaatggtaaaacaatggcaaaaagtcgttaaccagttagtagaatcaccaggtgctttatatcaatttaacgaatccttcttgagacaaaggttacaggccatgttaactgtgtataagagggacttacaaactgaaaaatttcttaaacttttggcggatgtttgtaggcctcttgtagatttttttggtttgggtggaaatgatattatttttaagagctgtcaagacccaagaaaacaatggcaaaccgttattcctctctctgttccggcagatgtctatactgcttgcgaaggtttggcgattagactaagggagacattaggattcgaatggaagaatttgaaaggtcacgagagagaagatttcttaagattgcaccagttattgggcaatttacttttctggattcgtgatgctaaattggtagtaaaattagaggattggatgaacaacccatgtgttcaggaatatgtagaagcccggaaagctatcgatcttccactagaaatattcggttttgaagtgcctatcttcctgaatggctatctattttcggagttgagacaattagaacttttgcttaggagaaaaagtgtgatgactagctacagtgtaaagactactggatctcctaataggctatttcagctagtttatttacctctaaaccctagtgaccccgaaaagaagaactcaaataactttcaagaacgtttggataccccaactggtttgtcccgtcgtttcctagacctaacccttgatgcattcgcaggtaagttacttaccgatccagttacacaagaattgaagacaatggcaggtttttacgatcatctttttggattcaaattgccatgtaaactcgccgccatgtcgaatcatccaggttcttcttcaaagatggttgtgttagcgaaacccaaaaaaggtgttgcttctaatatagggtttgaaccgatcccagatcccgctcatcccgtatttagggttagatccagttggccagagttgaagtacctcgaggggctattgtatttgccagaagacacacctttgaccatcgaattagcagagacctccgtatcgtgccaaagtgtctcgtcagttgcattcgatttgaaaaacttgacaacgatcttaggtcgtgtgggagaatttagggtcacagctgatcaaccctttaaactaacgcctataatcccggagaaagaagaatcttttattggtaaaacttatttgggtctcgacgcgggtgaaaggagcggcgtcggtttcgctattgttacagtggacggagatgggtacgaagtgcaaagattgggggtccacgaggatacacagcttatggccttgcagcaagttgctagtaaatccttaaaagagccagtatttcagcctctaagaaaaggcacctttagacaacaagaaagaatacggaaatccttacgtggttgctactggaatttttatcatgccttgatgataaaatatagggccaaagtagtacatgaggaatctgtcggaagtagtggtcttgtgggtcaatggttgagggcttttcagaaggatttgaagaaagccgatgttctccccaagaagggcggtaaaaacggtgtagataagaagaagagagagtcctcagctcaagacactctttggggtggtgctttctctaaaaaggaggagcaacagattgcgtttgaggtgcaagctgcaggttcttcgcaattttgtttgaagtgcggatggtggttccaactaggcatgcgtgaagtaaacagggtacaagaatcgggcgtcgtgttagattggaatagaagcatagttacctttttaatagaatcatccggcgaaaaagtttatggtttctccccacagcaattagagaagggtttcagaccagacatcgaaacttttaaaaagatggtaagagactttatgagacctcctatgtttgatagaaaaggcagaccggccgcagcttacgagagatttgttttaggaaggagacatcgaaggtacaggtttgataaagtatttgaggaaagatttgggaggtctgctcttttcatttgtcctagagtaggttgtggaaattttgaccacagctccgaacagtccgcggttgttttggccttgatcggatatattgccgataaggagggaatgtcaggtaagaagttggtttatgtacggctggccgaacttatggccgaatggaaactaaaaaaattagaaagatccagagttgaagaacaatcatccgctcaataa

SEQ ID NO: 144 - DNA, 3579 bp, Artificial Sequence
  Description of Artificial Sequence: Synthetic polynucleotide
atggcagaaagcaaacaaatgcagtgtaggaaatgtggagctagtatgaagtacgaagtcatcggtttgggtaaaaagtcatgtagatacatgtgtcccgattgtggcaaccatacctcggcaagaaagatacaaaacaaaaaaaaaagagataaaaaatatgggtcagccagtaaagcccaatctcaaagaattgctgtagcaggtgctctttaccctgacaaaaaagtacaaactatcaaaacctataaatatccagcagacttgaatggtgaggtgcatgatagcggtgttgccgagaaaatcgcacaagcaatacaagaggacgagattggacttttgggaccaagctcagaatatgcatgctggattgcatctcaaaaacagtctgagccttacagtgtagtcgatttctggtttgatgcagtgtgcgcagggggagtcttcgcctactctggcgctagattattgagtacagttttacagttatccggtgaggaatcggtgcttagagctgccttagcctcgtctccattcgttgacgatataaacttagcgcaagccgaaaagtttttggcggttagcaggcgtacaggtcaagataagttaggtaagagaattggggagtgctttgcagaaggaagattggaagctttagggataaaagatagaatgagggaatttgttcaagctatcgatgttgcacagaccgccggacaacgtttcgctgccaaattgaagatattcggtataagtcagatgccagaagctaagcaatggaataacgattccggactgactgtctgtatactacctgattattatgttcccgaagagaatcgcgcggaccaacttgtagtgttgttaagaagacttcgcgagattgcatattgcatgggtattgaagatgaagcgggtttcgaacatcttggaatagatcctggtgctctttcgaatttttcaaacggtaaccctaagagaggatttctagggaggctgttaaataacgatattattgcgttggcaaacaatatgagtgcgatgactccatattgggaagggcgtaagggtgaactcatagaaaggcttgcgtggttaaagcacagggcagaagggctgtatcttaaagaacctcatttcggtaactcctgggccgatcataggtcacgaattttctcaaggatcgcaggctggttatctggttgcgctggcaagttgaaaattgcgaaagaccaaatttctggagtacgtacagatctatttctgctaaaaagactgctggacgcagttccgcaatcggcgccatcccccgattttattgcgtcaatttcggcacttgacaggtttttagaagctgcagaatcgagccaggaccctgctgaacaagtgagggctctctacgcttttcacttgaacgcacctgcagtccgaagtatagccaataaagcagtgcaaaggtccgacagccaagaatggctgataaaagaactagacgctgttgaccatttagaatttaacaaagcgttcccatttttctctgacacaggaaaaaaaaaaaaaaaaggtgctaatagcaacggtgctccatcggaagaagagtacactgaaacggaatcaatacaacaacctgaggacgcggaacaggaagtaaacggacaagaagggaacggagcgtctaaaaatcaaaagaaatttcaaagaatacctagattcttcggtgaaggctccagatctgaatacagaattttaacggaagctccacagtatttcgatatgttttgtaataacatgagggctatatttatgcagttagaaagtcaaccccgtaaagctcccagagattttaaatgtttcctacaaaatcgattacaaaaattatacaaacagactttcttgaatgcacgaagcaacaagtgtcgcgctctgcttgagtcagttttaatctcttggggagaattttatacatacggtgccaacgaaaagaaatttagattaagacatgaagcttcagaacgcagcagtgacccagattacgtagttcagcaagccttggaaatcgcgcgtcgtctattcctttttggcttcgaatggagagattgctccgctggtgaaagagtggatttggttgaaattcacaaaaaggctatcagttttttgttggctattactcaagctgaggtctctgttggttcatacaattggcttggcaactcaacagtatcgagatatttatccgttgcgggaactgataccttatacggtacccaattggaagaattcctgaacgctacagtgttgagtcaaatgcgtggtctggccattagattgagttctcaagaacttaaggacggttttgatgtgcagctcgagtcttcctgccaggacaatctgcaacacctattggtgtatagggcttcgagagatttggcggcttgcaagcgcgctacttgtccagccgaactcgatcctaagattttagttttaccggtaggtgcattcatcgcttccgtaatgaaaatgatagaaagaggtgacgaacctttagctggtgcttatttacggcataggccacactctttcggatggcaaattagggtccgcggtgttgctgaggtagggatggatcagggtacagcattggcctttcaaaagccaacagagtcagaaccttttaaaattaagcccttctctgcacagtatggaccagttctgtggttgaacagtagtagttattctcaatcacaatatttggacggttttctatctcaaccaaaaaattggagtatgagggtgttgcctcaggcgggttcagttcgcgtcgaacaacgagttgctttgatatggaacttacaagcaggcaagatgagactagaacgctccggtgcgagggcctttttcatgcctgtaccgttttcatttaggccatccggcagtggggacgaagcagttttggcgcccaaccggtacttgggtctgttccctcattccggaggtatagaatacgctgtagtggatgtcctggattctgctggatttaaaattcttgaaagaggcactattgctgtcaatggtttctctcagaaaaggggagagcgccaagaagaagcccatcgtgaaaaacaaagaagggggataagtgatatagggcgaaagaagcctgtgcaggcagaagtcgatgcggcgaacgaattgcatagaaagtacactgatgttgccacaagattaggttgtagaatcgtcgttcaatgggcaccacaacctaaaccagggacagcaccgacagcgcaaactgtttacgcgagggctgttaggacagaagctccgaggagcggcaaccaagaagatcatgcaagaatgaaaagttcttggggttacacctggggtacgtattgggagaaacgaaaaccagaagatattttagggatttctacacaggtgtattggacaggaggtataggcgaatcctgtcctgctgtagcagtcgctttattaggtcatattagagcaacttcaacacaaacggagtgggaaaaggaagaagttgtctttggaagactgaagaagttctttccgagttaa

SEQ ID NO: 145 - DNA, 2958 bp, Artificial Sequence
  Description of Artificial Sequence: Synthetic polynucleotide
atggagaagagaattaataagatacggaaaaaattatctgcggataatgcaacaaagccagtctctcgttcaggccccatgaaaaccctgcttgtaagagtaatgacggatgatttaaaaaagaggttggaaaagcgtagaaaaaaaccagaagtgatgccgcaagtgatctcaaataacgcagctaataatctaaggatgctacttgatgattatacaaaaatgaaagaagcaatcctgcaagtttactggcaggaattcaaggatgaccatgttggactaatgtgcaaattcgcacaaccagcgtctaagaaaattgaccaaaataaattgaaacccgaaatggacgaaaaagggaatttaacaactgccgggtttgcctgctcgcaatgtgggcaaccattatttgtttataaattagagcaggtttcggaaaaaggaaaggcttacacaaattacttcggcagatgtaatgttgccgaacacgaaaaactcatattgttagctcagttgaagcctgagaaagactctgatgaggccgttacttactcgttggggaagtttggtcaaagagctctcgatttttattctattcatgtgacaaaggagtccacacatcccgtcaagcccttggcacaaattgcgggtaatagatacgcttcgggtccagttgggaaggccctttctgatgcatgtatgggcacaattgctagctttcttagtaaataccaggatatcataatagagcatcaaaaagttgtaaagggtaaccaaaagagattagaatcgctgcgtgagttggcgggtaaagaaaacttggaatatccatctgtcactctgcctcctcaacctcatactaaggaaggtgtagatgcgtacaatgaagttatcgctagagtccgtatgtgggtgaatttaaatttgtggcaaaaattgaagttatcgcgtgatgatgcaaaacctcttcttagactaaagggctttcctagcttccctgtagtggaaagacgcgaaaatgaagtcgattggtggaatacaattaacgaagtcaaaaaactgatcgatgcaaagcgagatatgggtcgagttttttggtctggtgttacagctgaaaaaaggaatacgatcttagaaggttacaactacttgccaaatgagaacgatcataaaaaaagagaaggcagtttagaaaatccaaaaaagccagctaagagacaatttggtgatttgctactttacctagaaaaaaagtacgccggagattgggggaaagtctttgacgaagcttgggagagaatagataaaaaaatagcaggattgacgtcacacattgaaagagaagaggcgagaaatgcagaagatgctcagtccaaagctgtcctcaccgactggttgagagccaaagcgtcctttgttctcgaacgcctaaaagaaatggatgagaaggaattttatgcctgcgaaatccagctacaaaaatggtacggagacttgagaggtaacccctttgccgtggaagcagagaaccgtgttgtagatatctccggtttctcaatcggtagcgatggacactccattcagtatcgcaacttgttggcctggaaatatttggaaaacggtaagagggaattctatttacttatgaattatggcaagaaaggtagaatcaggtttactgacggaacagacattaaaaagagtggtaagtggcaaggccttttgtacggtggtggcaaggccaaagtaatagacttaacatttgaccccgacgacgaacaactgataatactgcctttagcttttggtactcgacaggggcgagagttcatttggaatgatcttttgtcactcgagactggtttgataaaacttgcaaatggaagagtcatcgagaagacaatttacaacaaaaagataggtcgcgatgagcctgcactatttgtggccttgacctttgagagaagggaagttgtcgacccatccaatattaaaccagtcaacctaatcggtgtagatagaggtgaaaacatcccagctgttatcgctctgacagaccctgaaggttgccctttgccagaatttaaagattcgtctggtggaccaacagatatattacgtattggggaaggctataaagagaaacaacgtgctattcaggctgcaaaagaagttgaacagaggagagctggaggttacagtagaaaattcgccagtaaaagtagaaacttagcagatgacatggttagaaactctgcccgggatttgttctatcatgcggttactcacgatgcagtcttagtctttgaaaatctatcgcgcggttttggtaggcaaggcaagaggacttttatgacagagagacaatatacaaaaatggaagattggttaaccgcgaagctcgcatatgaaggtcttacttcgaaaacgtacctcagcaaaacgctggctcaatatacttctaaaacttgttcaaattgtggttttactattaccacggcagactacgacgggatgttggtgagattgaagaagacgagcgatggttgggcaacaacattgaataataaggaattaaaagcagaaggacagattacgtattacaatcgttataaacgccaaacggttgagaaagagttgtcagccgagttggatagactaagtgaagagagcggtaacaatgatatctcaaagtggactaaagggaggcgggatgaagccctctttttactaaagaagagattctcacatagacctgtgcaagaacaattcgtttgtttagattgtggccatgaggttcatgcagacgaacaggctgcgttaaatattgcgagaagctggctatttctaaattctaattcaacagagttcaagagctataaatccggaaaacaacctttcgtaggcgcgtggcaagccttctataaaaggagattaaaagaggtttggaaaccaaatgca

SEQ ID NO: 146 - DNA, 2919 bp, Artificial Sequence
  Description of Artificial Sequence: Synthetic polynucleotide
atgaaaagaattaacaaaattagaaggaggctggtcaaagattctaataccaagaaagctggtaagactggtccgatgaaaaccctattagtcagagttatgaccccagatttgagagaaagattggagaacctcaggaaaaagcccgaaaacatcccacaacccattagtaacacatcaagagctaatttaaacaagttattaactgactacactgaaatgaaaaaagcaatattgcatgtttactgggaagagttccagaaagatcctgttgggttgatgtctagagttgctcaaccggccccaaagaatatagatcaaaggaaacttattcctgtgaaggacggcaatgaaagattaaccagctccggtttcgcttgctcccagtgctgccaacccctgtatgtatacaaactggaacaagtaaatgataaaggtaagccacatactaactactttggtaggtgtaatgtatccgagcatgaaagattgatcttgttaagtccccataaaccagaagctaatgatgagttagtaacttatagtttaggtaagttcggacaacgagctttagatttctatagcatccatgttacaagagaaagcaatcaccccgtcaaaccactggaacaaatcggtggtaatagttgtgcgtcaggtccagtaggcaaagctttatcagacgcttgcatgggtgccgtggctagttttttgacgaaataccaagatattatactggaacatcaaaaggtaattaaaaagaatgaaaagagactcgctaacttaaaagatattgcaagtgccaatggtttagcttttcctaaaattaccttgccacctcagccacatacaaaggagggaattgaagcttacaataatgtagtagcccaaatagttatttgggtgaaccttaacctatggcaaaagttaaaaattggtagagacgaagccaaacccctgcagaggctgaagggttttccctccttccccttagtagagagacaagctaatgaagtggactggtgggatatggtgtgcaatgttaaaaaattgattaatgagaagaaagaggatggtaaagtgttttggcagaatcttgctggctacaagagacaggaagctttactgccttatttatcttctgaggaagataggaaaaaaggtaaaaaatttgctagatatcaattcggagacctacttctgcatttagaaaaaaaacatggcgaagattggggtaaagtttatgatgaagcctgggaaagaattgataagaaggtagaaggtctctccaaacatattaaattagaggaagaacgtaggtccgaagacgctcaatcaaaggcagcattaactgattggttgagagcaaaagcctctttcgttattgaaggattaaaagaagccgacaaagatgaattttgtagatgtgagttaaagttgcaaaagtggtatggagacctccgtggtaaaccttttgctattgaggctgaaaattctatactcgatatctctggattttcaaaacaatataactgcgcatttatatggcagaaagatggtgttaaaaagctaaatctatacttaattatcaattactttaaaggtggtaaattgcgttttaagaagataaagcctgaagcctttgaggcaaaccgtttttacactgttatcaataaaaaatctggggaaatcgtaccaatggaagttaatttcaatttcgatgatcctaatcttattattttacctcttgctttcggcaaaaggcaaggtagggagtttatttggaatgatttattgtcgctggaaacggggtctctcaaactcgcaaacggtagggtgatagaaaaaacattatacaacaggagaactcggcaggatgagccagctctttttgtggctctgacattcgagagaagggaagttttagattcatctaacatcaaaccaatgaatttaataggtattgaccggggtgaaaatatacctgcagttattgctttaactgatcctgagggatgtcctcttagcagattcaaggactcgttgggtaaccctactcacatcttaaggattggagaaagttacaaggagaaacaaaggacaatacaagctgctaaagaagtagaacaaaggagggcgggtggatatagtcggaaatatgccagcaaggccaagaatttagctgacgacatggttaggaatacagctagagaccttttatactatgccgtcacccaggatgccatgttgatatttgaaaatttaagtagaggcttcggtagacaaggtaagcgcaccttcatggcagagagacaatatactagaatggaagattggttgactgccaaattggcatacgaaggtctacctagtaagacgtacttatctaaaacactagcgcagtatacttccaagacatgcagtaattgtggtttcacaatcacttctgccgattacgatcgcgtcttggaaaaactaaaaaaaacagcgacaggttggatgactactattaatgggaaagaattgaaggtcgaaggacaaataacttactataatagatataaacggcaaaacgttgtaaaagacctgtcagtcgaactcgatcgacttagtgaagaatctgttaataatgatattagttcgtggacaaaaggtagatccggtgaagctttgagcctcctgaaaaaacgttttagccataggcctgtccaagaaaagtttgtatgtttaaactgtggttttgagacccatgcagacgagcaggccgctcttaatattgctagatcatggttatttttaagatctcaggaatacaagaagtaccagactaacaagacaacaggcaacacagataagcgagcattcgttgagacttggcaatctttttatagaaagaaattgaaggaagtctggaaacca

SEQ ID NO: 147 - DNA, 4077 bp, Artificial Sequence
  Description of Artificial Sequence: Synthetic polynucleotide
atgggaaaaatgtattatctaggcctggacatagggaccaattcagtaggctacgctgtcactgacccctcctaccatttgctgaagttcaagggggaacccatgtggggagcacacgtgtttgcggccggcaaccagagcgcagagcggagaagcttccgcacctccaggagaaggctggatcgcaggcagcagcgtgtgaagctggtccaagagatatttgccccagtgatttcccccatcgatccgcgcttctttattaggctccacgagtccgctctctggcgcgacgacgtggccgaaactgataaacatattttctttaatgacccaacatacactgacaaggagtactattcagattacccaacaattcaccatttgatcgtggaccttatggaaagttcggagaagcatgatcctcgacttgtctatttggccgtggcgtggctcgtggcacataggggccacttcttgaacgaggtggacaaggataacatcggggatgtgttatctttcgacgctttctatcctgaattccttgcttttctgtctgacaatggcgtcagcccgtgggtctgcgaatccaaggccctccaggctacgctattgtcaagaaatagcgtgaacgacaagtacaaggctcttaagtctttgatttttggaagccagaagcccgaggacaactttgatgcaaatatctcggaggacgggctgattcagctcctcgctgggaaaaaggtcaaggtcaataagctgtttccacaggagtcaaatgacgcgagcttcacccttaacgacaaagaggatgccattgaagagatcctggggacactcaccccagacgagtgcgagtggatagcccatattaggcgcctctttgattgggccataatgaaacatgcgcttaaggacgggcgcacgatatccgaaagcaaggtcaaattgtacgagcagcaccaccatgatctgacccagctaaaatattttgtaaaaacatatctggccaaggagtacgatgatatcttccgcaacgtggatagtgagaccaccaaaaactacgtcgcgtactcataccacgtgaaagaagttaagggcacgctgcctaagaacaaggcaacacaagaggagttctgcaagtacgttctcgggaaagttaaaaatatagagtgcagcgaggccgacaaagtggattttgacgagatgattcaacgcctgaccgacaattcgtttatgcctaaacaggtgagtggagagaatcgcgtgattccatatcagctctattactatgaactcaagactattctgaataaggccgctagctatttacccttccttacgcagtgcgggaaggatgccatttctaaccaggataaactcttgagtataatgacatttcgaattccctatttcgtgggtccgcttcgtaaggataacagtgagcacgcttggctggagcggaaggctggcaaaatttatccatggaatttcaacgacaaggtggatctggacaaatccgaagaagcctttatccgcaggatgaccaatacttgcacatactatcctggggaggatgtccttccactggactctctgatctacgaaaagttcatgattttgaatgaaattaacaacataaggatcgatgggtatcctatttccgtcgacgtgaagcagcaggtgttcgggctctttgagaagaagcgacgggtgaccgtgaaggatattcagaatcttctcttatcgctgggagccctggataaacacggaaaactgaccgggatagatactacgattcattctaattacaacacgtatcaccattttaagtcactgatggagaggggcgtcctaacaagagatgacgtggagagaatagtggaacgaatgacatattctgatgacaccaagagagtgcggctttggctgaataacaactacggcactctgacggcggatgatgtaaagcatatttcccgactccgtaagcatgacttcgggcggctgtctaagatgtttctaacaggcctcaagggtgtgcataaggaaactggggagcgcgctagcatcctggattttatgtggaacaccaatgataacctgatgcagctcctgtcagaatgctacacattttcggacgaaatcaccaagctgcaggaggcttactatgccaaggcccaactaagcttgaatgatttcctggattctatgtacatcagcaacgccgtaaaacgaccaatttataggacactggcagtggttaacgacattaggaaagcatgcggaacagctcccaagcgaatctttatcgagatggcccgcgacggcgagagtaagaagaaaaggtcagtgactaggcgggagcagatcaagaacctttaccgctctatccgaaaagacttccagcaagaggttgatttccttgagaagatcttagagaacaagtcagatggacagctccaatccgatgctctgtatctgtacttcgctcagctgggacgagatatgtacactggcgaccccattaaactagaacatatcaaggaccaatcgttttataatatcgaccacatctaccctcagtccatggtgaaagacgatagtctggacaataaggtgctcgtccaaagtgagattaacggagaaaagtcgagcagatatcctttggacgctgcgatccgcaacaagatgaagcccctgtgggatgcttactacaatcatggactgatcagcctgaagaagtatcagagactgacccggagtacccctttcacagacgatgagaagtgggattttatcaatagacaactggtggaaaccaggcagtccacgaaagctctggccattcttctgaagagaaagtttccagacacagagatcgtctattcaaaggccggcctcagttccgactttagacatgagttcggactcgttaaatcacgaaatataaacgatctccaccatgcaaaggacgcattcctcgcgattgtgactggaaatgtctatcacgaaagatttaataggcggtggttcatggttaaccagccatactcagtgaagaccaagacccttttcactcactctattaaaaatggcaacttcgtggcttggaatggtgaggaggatcttggaagaattgtgaagatgttaaaacagaataagaataccatccactttactagattcagctttgaccgaaaagaggggctattcgatattcaaccgttaaaggcttcaacaggtctcgttccacgaaaggccggactggacgtagtgaaatacggcggctatgataagagcaccgcagcttactacctccttgtgcgatttacgctcgaggataagaagacccaacacaagctgatgatgattcccgtggagggactgtacaaagctcgaattgaccatgataaagagtttctcacagattacgcacaaaccaccatctctgagattctccagaaagacaaacaaaaagttataaacataatgtttccaatgggtacaaggcatattaaactgaacagcatgatctccattgatggcttttatttgtccattggaggaaagtctagtaaaggcaagtctgtcctctgccatgccatggtacccctaatcgtcccacacaagattgaatgctacatcaaggctatggagagttttgctcggaaatttaaagagaataataagctgcgtattgtggaaaaattcgacaagataaccgttgaagacaatctgaatctgtacgagctctttctgcagaagctgcagcataacccctataataagttcttctccacacagttcgatgtactgaccaacgggcgatcaactttcacaaagctaagtcctgaggaacaggtgcaaacactcctaaacattctttccatttttaagacctgcagatcttcaggatgcgacttgaagagcattaacgggagcgcacaggcagctaggatcatgatctcagctgacctgacagggctgagtaaaaaatactccgacattcggcttgtagagcaaagcgccagtgggttgttcgttagtaagtcgcagaacctgctggaatacctgtaa

SEQ ID NO: 148 - DNA, 4005 bp, Artificial Sequence
  Description of Artificial Sequence: Synthetic polynucleotide
atgtcttctttgacgaagtttacaaacaaatactctaagcagcttacaattaagaacgaactgattcccgtaggaaagactctggaaaacatcaaagagaatgggctgatagacggcgacgaacaactgaatgagaactatcagaaggccaaaattatcgtggatgacttcctgagggattttattaacaaggccctgaataatacccagatcggcaattggcgggaactggccgacgctctgaacaaagaagatgaggacaatatcgaaaaattacaagacaaaatcaggggcattattgtcagtaagttcgagacattcgatctgttctcttcgtactccattaagaaggacgagaaaatcatcgatgatgacaatgacgttgaggaagaagaactggacttgggtaaaaagacctcatccttcaagtatatttttaaaaaaaatctgtttaaattagtgctccccagttatttaaagacaactaaccaggacaagcttaagattatctcctcttttgacaactttagcacctattttagaggcttctttgaaaatcgcaagaatattttcactaagaagcccataagcacctctattgcctacagaatcgtacatgataacttcccaaaatttttggataacattagatgttttaatgtatggcagaccgaatgtcctcagttaattgtgaaggcggataactacctcaaatccaagaatgtgatcgccaaagataagtctcttgctaactactttacggtcggagcctacgattacttcttatctcaaaacggtattgacttttacaataacattatcgggggattgcctgccttcgccggccatgagaaaattcagggcttaaacgagttcataaatcaggaatgtcaaaaggactcagagctgaaatcaaagcttaagaatcgacacgcatttaaaatggcggtcttgttcaaacagatcctcagcgatagagagaaaagcttcgttattgatgaattcgagagcgacgcacaggtgattgatgccgtgaagaacttctatgcggaacagtgtaaagacaataatgttattttcaacctattaaacttgattaagaatatcgcgtttttaagtgacgatgaactcgacggtatctttatagaaggcaagtacctgtcctctgtcagccaaaaactctactcagattggtccaagctaagaaatgacatcgaggacagtgctaacagcaaacagggcaataaagagctggcaaagaaaatcaagactaataaaggggatgtggagaaggcgatatctaaatatgagttctccctctccgaactgaactccatcgtccacgataataccaagtttagtgatctgttgtcgtgtacactgcacaaagtggccagtgaaaaactcgtcaaggtgaacgaaggcgattggcccaaacacctgaaaaataatgaggagaaacagaagatcaaagaacctttggatgcgttgctcgaaatatataacacactgttgatcttcaactgtaaaagcttcaacaagaacgggaacttttatgtagactacgatcgatgtataaatgaactgagcagcgtcgtttacctgtacaacaagactcgcaattattgtacgaaaaaaccatataacaccgataagttcaagcttaatttcaacagtccccagctgggagaagggttcagcaaatcaaaagaaaacgattgcctgacattactctttaaaaaggatgataattattatgttgggattattaggaaaggcgctaagatcaactttgacgacacacaggccatagctgacaacactgataactgcatctttaaaatgaattactttctgttgaaggacgccaaaaaattcattccaaaatgctctattcagctcaaggaggttaaggcccatttcaagaagtctgaagatgactacatcctctctgacaaggaaaaattcgctagtcctctggttatcaaaaaaagtaccttcttgctggctacagctcacgtgaaaggcaagaaagggaacattaagaagttccaaaaggaatacagcaaagagaatccaaccgagtacagaaattctctgaacgaatggatcgcattctgtaaagaatttctaaagacgtacaaggccgctaccattttcgatattaccaccttgaaaaaagccgaggagtacgccgacatcgtcgaattctataaagacgtggataacctgtgttacaaattggaattctgcccaattaagacctctttcattgaaaacctcatcgacaatggggacctctacttatttagaattaacaataaggatttttcttcgaaatctaccggaactaaaaatctgcacacactgtatctgcaagcaatcttcgatgaacgtaatctcaacaaccctacaataatgctgaacggcggtgctgaactgttctaccgtaaagagagtattgaacagaagaatcgaatcacacacaaagcgggcagtattctcgtcaataaggtgtgcaaagacgggaccagcctggacgataagatcaggaatgaaatatatcagtatgagaacaagtttatcgacaccttgtcggatgaggcaaagaaggtgctacctaacgttatcaagaaggaagctacccatgacataaccaaggataagcggttcacttctgacaagttcttcttccactgtcctctgaccattaactacaaggaaggagacactaaacaattcaataatgaagtacttagctttttgcggggtaatcccgatattaacataattggtatcgaccggggagaacggaacctgatatacgtgacagtaattaatcagaaaggagaaatcctggattccgtatccttcaataccgtgactaataaatctagtaaaatcgagcagacggtcgactacgaggaaaagttagcagtcagagagaaggagagaatcgaggccaaacgttcctgggatagtatcagcaagattgctactctgaaagaaggatatctgtccgctatcgtccatgagatctgtttgttgatgatcaagcacaatgctatagtggttctggagaacctgaacgcaggcttcaagcgaattagagggggcctgtcggaaaaaagcgtttaccagaagtttgaaaagatgctaatcaataagttaaattactttgtaagtaaaaaagaaagcgattggaataagccatcaggacttttaaacgggctgcaactgagcgaccagtttgagtcattcgaaaaactgggtattcagagtggtttcatattctacgtacctgccgcttacacttcaaagatcgatcctacaactggttttgcgaatgtcctgaatctgtctaaggtgaggaatgtggacgcaatcaagtctttcttcagcaacttcaacgagatatcttacagcaagaaagaggctctgtttaaattcagttttgatctggatagcctgagcaagaaaggattctcttctttcgtaaagttttctaagtccaaatggaacgtctacacgttcggagagagaatcattaaaccaaagaacaagcaggggtatcgggaagacaaaaggatcaatctgactttcgaaatgaagaaactattgaatgagtacaaagtctcattcgatttggagaacaatctgatccccaatctgaccagcgctaacctcaaagacacattctggaaggagctgtttttcatctttaagaccaccctgcagctacggaatagtgtcacaaatgggaaagaggatgtactgatctcacctgtgaaaaacgccaagggggagttctttgtgtccggcacccataacaaaaccctgcctcaggactgtgacgcgaacggggcctaccacatcgcgctaaaggggttaatgattctcgaacgtaataatctggtgcgcgaagaaaaagacacaaagaaaattatggccatcagcaacgttgactggtttgagtacgtgcagaagcgtcgaggagttttgtaa

SEQ ID NO: 149 - DNA, 3717 bp, Artificial Sequence
  Description of Artificial Sequence: Synthetic polynucleotide
atgaacaactatgacgagttcactaaactttaccccattcagaaaaccatcagatttgaactgaagcctcagggtcgtaccatggaacacttggaaactttcaactttttcgaggaggacagggatagagctgagaaatacaagatcttgaaagaggccatcgacgagtatcacaaaaaattcatcgatgagcatctcaccaacatgtcgctggattggaacagtctcaagcagatttccgagaagtactataaatctcgggaggagaaagataaaaaggtgtttttgagcgagcaaaagcgaatgcgacaggagatagtctctgaatttaagaaagatgatcggtttaaagacctattttccaaaaagcttttttcagagctgctgaaggaagagatctataaaaaaggcaatcaccaagaaattgatgccctgaaatcattcgacaaattcagtgggtatttcataggactgcatgagaaccggaagaatatgtatagtgatggagacgagatcacagccataagcaatcgaatcgttaacgagaatttcccgaagttcctggataacctgcagaagtatcaagaggctaggaaaaagtaccctgagtggatcatcaaggctgaatcagctctggtggctcacaatatcaagatggatgaagtctttagtcttgagtactttaataaagtccttaaccaggagggcatccagcgctataacctggctctcggtggctacgtcacaaaaagcggagaaaagatgatgggtctcaacgatgcactgaatttggctcatcagtcggagaagtcatctaagggacgcatacacatgacaccactgtttaaacaaatcctgagcgaaaaggaatcattttcctacattcccgacgtattcaccgaggactcacaactgctgcctagtataggggggtttttcgctcagatagagaacgacaaagatggcaacatttttgacagagccttggagttgatttcatcttacgccgagtacgatacggagcgcatttatattcgccaggcggatatcaacagggtttccaatgtgatctttggcgagtggggaacgctgggcgggctgatgcgggaatacaaagccgactcgatcaatgacatcaacctggagagaacatgcaagaaggtcgataaatggttggatagcaaagagttcgccctgagtgacgtcttggaagctatcaaaagaaccggaaataatgacgcgttcaacgagtatatctctaaaatgaggaccgcgagagaaaaaattgatgcagcaaggaaggagatgaagtttatatctgagaagatctcaggcgatgaagagtccatccatattattaaaactcttctggactcagtgcagcaattcctgcacttttttaacctcttcaaggccaggcaggatataccgttagacggggctttttatgccgagtttgatgaagttcattcgaaactttttgctatagtgcctctctataataaagttcgcaattacctgacaaagaataacttaaacacaaagaaaatcaagctcaacttcaaaaacccaacactggcaaacggatgggatcagaacaaggtatatgattacgcctcattgattttcctccgggacgggaattactatctggggatcatcaaccctaagcgcaaaaagaacattaagttcgaacagggatctggcaatggtcccttctataggaaaatggtatacaaacagattcctggccccaacaagaatctcccacgcgtctttctgacgtccactaagggaaagaaggagtacaagccgtctaaagaaattatcgagggctatgaggcagacaagcatattaggggtgacaagtttgacctagacttttgtcataagcttatcgactttttcaaggagtccatagagaagcacaaagattggtcaaagtttaatttctatttttctccaacagagtcctacggggatatctctgagttctatctggatgttgaaaagcaggggtacagaatgcacttcgaaaatatctcagcagaaactatcgatgagtacgtagagaaaggagatctgtttcttttccaaatctacaataaggattttgtgaaggccgccactgggaagaaggacatgcacactatttactggaacgctgcattttcccctgaaaatctgcaggacgtagtagtgaaattaaatggtgaggcagaactgttttaccgcgataaatcagacatcaaggaaatagtgcaccgggaaggcgagattcttgttaaccgaacatataatggcaggacacctgtccctgataaaattcataagaaactgaccgattaccacaacggtcgaaccaaggatctgggcgaggccaaggaatacctcgataaggtgaggtacttcaaagcccattatgacatcaccaaggaccgaagataccttaacgacaaaatctacttccatgtcccactcaccttgaacttcaaagctaacggtaagaagaacctcaataaaatggtgattgaaaaatttctgtccgatgagaaggcccatatcatcggcattgatcgcggcgagagaaatctcctttactattctatcattgatcggtcgggaaagattatcgaccaacaatcactgaatgtcatcgacggattcgactatagagagaagctgaaccaacgggaaatcgagatgaaggacgcgcgccagtcctggaacgctatcggcaaaattaaagatttgaaagaaggttacctctccaaagcagtgcacgaaattaccaaaatggcaatccagtacaatgctattgtggtaatggaggagttaaattacggatttaagcgcgggaggttcaaggttgaaaagcaaatttaccaaaaatttgagaacatgttgattgataagatgaactacctggtgttcaaggacgcacctgacgagtcgccaggcggcgtgttaaatgcatatcagctgacaaatccactggagagctttgccaagctaggaaagcagactggcattctcttttacgtccctgcagcgtatacatccaaaattgaccccaccactggcttcgtcaatctgtttaacacctcctccaaaaccaacgcacaagaacggaaagaatttttgcaaaagtttgagtccattagctactctgccaaagacggcgggatctttgctttcgcattcgactacaggaaattcgggacgagtaagacagaccacaagaacgtctggaccgcgtacactaatggggaacgcatgcgctacatcaaagagaaaaagaggaatgaactttttgacccttcaaaggaaatcaaggaagctctcacctcaagcggtatcaaatacgatggcgggcagaatattttgccagatatcctcagatcgaacaataatggacttatctatactatgtactcctccttcattgcagcaattcaaatgagagtgtacgatggaaaggaggattacattatatcgccaattaagaactccaaaggcgaattcttccgcacggatcctaagcgaagagaactcccaatcgacgctgatgcgaacggcgcctataatatagccctgcggggtgaattaacaatgcgcgctattgccgagaagttcgaccccgattcagaaaaaatggctaagcttgagctgaaacacaaagattggttcgaattcatgcagacaagaggcgactaa

SEQ ID NO: 150 - DNA, 3897 bp, Artificial Sequence
  Description of Artificial Sequence: Synthetic polynucleotide
atgactaagaccttcgattccgagttcttcaacctttattccctgcagaaaactgtaaggtttgagctgaagccggtgggcgagacagccagcttcgtagaggatttcaagaatgagggtctcaaacgggtagttagtgaggatgagaggagagcagtggactatcagaaggtgaaagagatcatcgatgactatcaccgggatttcatagaggagtcgttgaattacttccctgagcaagtatccaaagacgcgctggaacaggcctttcatctttaccagaaactgaaggcagcgaaggttgaggagcgggaaaaggccttgaaagagtgggaagccctgcagaaaaagctcagagaaaaggttgtcaaatgcttcagcgacagcaacaaagccaggttcagtaggatcgataagaaagaactgatcaaagaagacttgatcaattggctggttgcacagaaccgggaagatgatattcccaccgtagagaccttcaacaacttcacaacttacttcaccggcttccatgagaatcgtaaaaacatctacagtaaagatgatcatgcaaccgccatctccttccggttgatccacgagaatctccccaagttctttgacaacgtgataagtttcaataagttgaaagagggatttcccgaactcaagttcgataaagtgaaggaggatctggaagtggattatgaccttaagcacgctttcgagatagagtacttcgtgaactttgtgactcaggccggcatcgatcagtataactacctcctcgggggtaagacgctcgaggacggtactaagaagcaaggaatgaatgagcaaattaatctatttaaacagcagcagaccagggataaggctagacagatccccaagcttattcctctttttaaacagatcctaagtgaaaggacagaaagtcaaagcttcatacctaagcaatttgaaagtgatcaggagctgtttgactccctgcaaaagctgcacaacaattgccaggacaagtttaccgtgctgcagcaggctatcctcggactggctgaggcggatcttaagaaggtattcattaagactagcgacctcaatgcccttagtaacaccatctttggaaattactccgttttcagcgatgccctcaatctatacaaagagagcttgaagactaaaaaagctcaggaagcttttgaaaaattaccggcacattctatacacgaccttatacaatacttagagcagttcaacagcagcctcgacgctgagaaacagcaatccacagacaccgtcctgaattacttcatcaaaaccgatgaactgtactcccgatttatcaagagcacttcagaagccttcacgcaagttcagcctctgttcgagctggaggcactgtccagcaagagacgaccgccagagtctgaagacgagggagccaagggtcaagaggggtttgaacagataaagcgaattaaggcttacttggatactctcatggaggcggtgcatttcgctaagcctttgtacctggttaaaggccgaaaaatgattgaggggctagataaggatcagtctttttacgaggcttttgaaatggcctaccaggaattggaatccttgatcattccaatctataataaagcccggagttatctgagcaggaagcccttcaaagccgacaagttcaaaataaattttgacaataatacgctactgtctggttgggacgctaacaaggaaacagccaatgcttccatcctgtttaagaaagacggcctgtactacctgggaattatgccaaaaggcaaaacttttttgttcgattactttgtgtcatcagaggatagcgagaagttaaagcaaagacggcagaagaccgccgaagaagccctcgcacaagacggagaatcatatttcgagaaaattcgatataagctcctgcctggcgcatcaaagatgttgccaaaagtcttcttttccaacaaaaacatcggcttttataaccccagcgatgatatccttcgcatccggaacaccgcctcacataccaaaaatggaactccacagaagggccactcgaaggttgaattcaaccttaacgattgtcacaaaatgattgatttttttaagagctccattcagaaacaccccgaatgggggtcctttggcttcaccttttctgatacttcagacttcgaggacatgtccgccttctacagggaggtggagaaccagggctatgtcatctccttcgacaaaataaaagagacatacattcagagccaggtcgagcagggaaatctgtacctgtttcagatctataacaaggatttcagtccctatagcaagggcaagcccaatttacataccctgtactggaaggccctgttcgaagaggcaaaccttaacaatgtagttgctaagctgaatggggaagcagagatcttcttccgaaggcacagcatcaaggcaagcgacaaagttgtacatcctgctaaccaggccatcgataacaagaacccgcatacagaaaagacacagtcaacctttgaatacgacctcgtgaaggacaagaggtacacacaagataaattcttcttccacgtgcccatcagcttgaattttaaagcgcagggagtgagcaaatttaacgacaaggtcaacggcttcctgaagggaaaccccgacgtgaatatcatcggaattgatcgcggtgaaagacatctcctctactttactgtggtgaaccagaagggtgagatcctagtacaggagagcctgaacacccttatgagtgataagggccatgtgaatgattaccagcagaagctggacaagaaggaacaggaaagggacgcagcgcggaagtcctggaccactgttgagaatatcaaagaactgaaggagggatatcttagccatgtggtacacaaacttgcacatctgattatcaagtataatgccatagtctgcctggaagacttgaacttcggtttcaagcgaggaaggtttaaagtggagaagcaggtgtaccagaagtttgagaaagcccttattgataagctaaactaccttgtctttaaggaaaaagaactcggcgaagttggccactatttaaccgcctaccaactaaccgcccctttcgagtcttttaagaaactgggaaagcagagcggaatactcttctatgtgcctgcagactacacctctaagatcgaccccactaccggctttgtaaactttctagatctccgctatcagtcagtagaaaaagccaaacagctcttgtcagattttaacgccatccgatttaattccgtccaaaattacttcgagttcgaaatcgactataaaaaacttacccccaagagaaaggttgggacgcagtctaagtgggtaatctgcacttacggtgacgtgagataccagaaccgccgaaaccagaaaggtcattgggaaaccgaggaagtgaatgtgactgagaagctcaaggccctcttcgctagcgacagtaaaacaacaacagttatcgattacgccaatgacgataatcttatagacgtgatcttggaacaagacaaagcctctttttttaaggaattgttgtggttgctgaaacttacaatgacccttaggcacagcaagatcaaatcagaggatgacttcatcctcagcccggtgaagaatgaacagggagagttctacgattcacggaaggctggagaggtgtggcccaaggatgccgacgcgaacggggcctaccacatagctctaaaaggtctgtggaacctgcaacaaatcaatcaatgggagaaaggtaagacactgaacctggccatcaaaaatcaagattggttctcattcatccaggaaaagccttatcaagagtga

SEQ ID NO: 151 - DNA, 3708 bp, Artificial Sequence
  Description of Artificial Sequence: Synthetic polynucleotide
atgcatacgggaggccttttatcaatggacgcaaaagagttcaccgggcagtatccattatctaagacactccgcttcgagctgaggcccattggcaggacctgggacaacctggaggcgtcgggctacctggctgaggacagacatcgcgcagaatgctatccgagagctaaggagcttttggacgacaatcatcgcgcgttccttaaccgggtgctcccacagatcgatatggactggcacccgatcgctgaggctttttgcaaggtccataagaaccctgggaacaaagagctcgcccaggactacaacttgcagctgagcaagcgacggaaagagatttctgcctaccttcaagacgccgatggctacaaagggctcttcgcaaagcccgcattggatgaggccatgaaaatcgccaaggagaacgggaatgaaagtgacatcgaagttctcgaagcgtttaacggatttagcgtgtactttaccggctatcatgagtcaagggagaatatttatagcgatgaggacatggtctctgtggcctaccggattaccgaggataatttcccgaggtttgtttcaaatgcactaatattcgacaagttaaatgagagccacccagacatcatctcggaggtcagcggcaacctcggagttgacgatattggcaaatacttcgacgtgagcaactataacaacttcctctcacaggctggcatcgacgactataatcatattataggcggccacactactgaggatggtctcattcaggcattcaatgtagtcttgaatcttaggcaccagaaggaccctgggtttgaaaagatacagttcaagcagctgtataagcagatattatccgtgcgaacatctaaaagttacatccccaaacagtttgataactcaaaggagatggtggattgcatatgcgattatgtgtcaaaaattgaaaagagcgagactgtggagcgggctctgaagctcgtcaggaacattagctcctttgaccttagaggaattttcgtcaataaaaagaatctgaggatcctgagcaataagctaataggagattgggacgccatagagacagcattgatgcattccagctcaagcgagaatgataagaagtctgtctacgatagcgctgaagccttcacgctggacgatatcttctcttccgtgaaaaaatttagtgatgcgtccgcagaagatatcgggaatcgagccgaagatatctgcagggtaatttcagagaccgcccctttcatcaatgacctgcgcgccgtggacctggatagcctgaatgacgatggttacgaagctgcagtttctaagatcagggagtctctggagccatatatggacttgtttcacgaacttgagatctttagcgtgggcgacgagttcccgaaatgcgcagctttctatagcgagttagaggaggtcagcgagcaattaatcgagatcatacccctgtttaataaggcacggagcttttgtactcgcaagcgctacagcaccgacaagattaaagttaatctgaaatttccaactctcgcagacgggtgggacctaaacaaggaacgcgataataaagccgccatccttagaaaggacggaaagtactatcttgccatcctagatatgaaaaaagatctgagttccattcgtactagcgatgaagacgaatcttctttcgaaaaaatggagtataagctgctcccctcgccagtcaagatgctacccaagatctttgtgaagagcaaagcagccaaggaaaagtacgggctgacggacaggatgctggagtgctacgataagggaatgcataaatcagggtcagcttttgacttgggcttttgccatgagctaatcgattactacaagcgctgtatcgccgagtatccaggatgggacgttttcgactttaaatttcgggagacttctgattatggttcaatgaaggagttcaacgaagatgtcgctggtgccggttactacatgagccttcgcaagattccttgttccgaagtctaccggctactggacgagaaatctatatatttgttccagatatataacaaggactacagtgagaatgcacatgggaataagaatatgcatactatgtattgggaaggtctcttttcaccccaaaatttggagtcacccgtgttcaaacttagcggtggcgcagagctgttctttaggaaatccagtatacccaatgacgccaagacagtccacccaaagggtagcgtcctggtgcccagaaacgatgtgaacggcaggagaatccctgacagcatttaccgagaacttaccaggtacttcaaccgcggcgactgtagaatctctgatgaggcaaagtcttatctggataaggtgaagactaagaaggcagatcatgacattgtgaaagaccgccgctttactgtcgacaaaatgatgtttcacgtgcctatcgcaatgaattttaaggcaatctcaaaaccgaatctgaacaagaaggtgatagatggcattatcgatgaccaggacctcaagatcatcggaatcgacagaggtgagcgaaacctgatatacgtcacaatggtagatcggaagggtaatattctgtaccaggattcactaaacatcctcaatggatatgactatcgaaaagctctcgatgtcagggaatacgacaacaaggaggcgcgacggaattggacaaaggtggaaggcatacggaagatgaaggaaggctatctgtcactagctgtctccaaattggctgatatgattatagagaacaacgccattatcgtgatggaagatctcaaccatggattcaaggcaggaagaagtaaaattgagaagcaggtgtatcagaagttcgaaagcatgcttattaataagttgggttatatggtcttaaaggacaagtctatcgatcagagcggcggcgcactccatgggtatcagctggctaaccatgtcaccacactagcatccgtaggcaaacagtgtggcgtgattttctacattcctgctgcgttcacttctaagatcgatcctaccacgggattcgcagacctgttcgcactgagcaatgttaaaaacgtggcctccatgagggagttctttagcaaaatgaaaagcgtgatttatgacaaggccgagggcaagttcgctttcacatttgactacctggactacaatgtgaaatcagagtgcgggagaaccctgtggaccgtatacacggtaggggaaagattcacttacagtcgagttaatcgggagtatgtccgtaaagtgccaactgacatcatctacgatgcccttcagaaggctggcataagtgttgagggggatctaagggacaggatcgctgaatcggatggcgatactctcaaatcaatcttctacgccttcaagtatgccctcgacatgagggtagagaaccgggaggaggactatatacagtctcccgtgaagaatgcgtcgggagagttcttctgctcaaaaaacgccgggaaatctttgccgcaggattctgatgcaaatggggcttataacattgctctcaaaggcatcctgcagctgcgcatgctatctgaacaatatgacccaaacgctgaaagcattagattgccattgatcaccaataaggcttggctgactttcatgcagagcggtatgaagacatggaaaaactaa

SEQ ID NO: 152 - DNA, 3783 bp, Artificial Sequence
  Description of Artificial Sequence: Synthetic polynucleotide
atggattcccttaaggacttcacaaatctttaccccgtgagtaaaaccctgagatttgaactcaagcccgtgggaaagactctcgagaatatcgagaaggccgggattttgaaggaagacgagcatcgggcggaaagttacagacgggtgaagaagattatagatacttatcacaaggtctttatagacagctctttagagaacatggcaaagatgggcatcgagaacgaaatcaaggccatgctgcagtccttctgcgagctgtataaaaaggatcatcggaccgaaggcgaagacaaggcgctggataagatcagggcagtgctgcgcggcctcattgtgggtgccttcactggggtgtgcgggcggagagagaacactgtgcagaatgagaaatacgagagtttgttcaaagagaaactcatcaaggaaatcctgcccgacttcgtcttaagcacagaagccgaatctctcccattttctgtcgaggaggccacgcgttcccttaaagagttcgacagtttcacttcatactttgccggattttatgaaaaccgtaaaaatatatactccactaaaccacagtcaactgcaatagcttacaggttaatccacgaaaacctgccaaaattcatcgacaatatactcgtctttcaaaaaatcaaggaaccaatcgcgaaggaacttgaacacatccgggctgactttagtgcgggaggatacatcaaaaaagacgagcgcctggaggatatattttcactaaattattatattcatgtactgagccaggctggcatagaaaagtacaacgctctaattgggaaaatcgtgacagaaggtgacggggaaatgaaagggctaaacgaacatattaacttatataaccaacagcggggtcgagaagatcgtctgcccctgttcagacctctgtataagcaaatactctccgacagagagcagctatcatatctgcccgagtcctttgagaaagatgaagagctgctccgggcgctcaaggagttctatgatcatatagccgaggacattttgggcagaactcagcaactcatgacgtctatttctgaatatgatctgtctcgtatctatgtcaggaatgatagccagctgaccgatatatccaagaagatgctgggggactggaacgccatttatatggcgagggagcgagcatacgatcacgagcaggcacccaagagaatcacagccaaatatgagagagaccgcattaaggcgctgaagggcgaagaaagtatcagtctggccaatctgaactcctgcatagctttccttgataacgtgagggattgcagagttgatacttacctgagtaccctgggccagaaggaagggcctcacggcctctctaatctagtggagaatgtatttgcctcctaccacgaagctgagcagctgctgtcatttccgtacccagaggaaaataatttaatacaggataaggacaacgtagtgcttatcaaaaatctactggataacatttccgacctccagcgctttctcaaaccactttgggggatgggcgacgagcctgataaggatgagcgcttttacggcgagtacaactacatcaggggcgccttggaccaggtgattcccctctataataaagtcaggaattacctgacccgaaagccatacagtacaagaaaggtgaaattaaatttcggcaatagtcagctgctgtctggttgggaccgaaataaggagaaagacaacagctgcgtaattctcagaaaaggacagaacttttatttggccatcatgaataacagacacaagagatctttcgagaacaaagtgctccctgagtataaggagggggaaccctacttcgagaagatggactataaattccttcctgatccaaataaaatgctgcctaaagtatttctgtcaaaaaaaggtatagaaatctacaaaccttcacctaagctacttgaacagtatggccacggcacccataaaaaaggggacacgttcagcatggacgacctacacgaactgattgacttctttaagcacagcatagaagctcatgaggactggaaacagttcggattcaaattctcagataccgcgacctacgaaaacgtgtctagtttttaccgggaagtcgaggaccagggctacaagctcagcttcagaaaagttagcgaatcttacgtctactcccttatagatcaaggtaagctgtatctctttcaaatctacaacaaggacttttccccatgtagcaagggcacccccaatctgcacactctctactggcggatgctgttcgacgagcgtaacctggcagacgtgatctacaaattagatggtaaagctgagatcttctttcgtgaaaagagcctaaagaacgatcaccccactcaccccgccggaaagcccattaagaagaaaagtaggcagaagaaaggagaagaatcgctatttgagtacgacctcgtcaaggatcggcattatacaatggataagttccagttccatgtgccaataactatgaatttcaagtgcagtgctggcagtaaggtgaatgacatggtaaacgctcatatccgggaggcaaaggacatgcatgttattggaattgataggggtgagcgtaatctcctctacatctgtgttattgactcccgcggcacaatcctcgatcagatttccttgaatacaattaatgatatagactaccatgacttgcttgagtctcgcgacaaagatagacagcaggagagaagaaattggcagaccatcgaaggcatcaaggaactcaagcaaggctacctttctcaggcagtgcatcgaatagccgagctgatggtggcttataaagccgtcgtggcactagaagacctaaatatgggatttaaacgaggcaggcagaaggtggaatcatccgtataccagcagttcgaaaaacagttgatagacaaactcaattaccttgtagacaagaagaagcggcctgaggacatagggggcctgcttagagcgtatcaatttacagccccattcaagtctttcaaagaaatgggtaaacagaacggttttctgttttacatcccagcgtggaacaccagcaatatagatccaaccactggcttcgtcaatctgtttcatgctcagtatgaaaatgtggacaaggccaaatccttctttcagaaatttgacagcatctcctataacccaaagaaagactggtttgaattcgcctttgactataagaatttcactaagaaggccgagggatcaagaagcatgtggatattgtgcacgcatggctcacgtataaagaactttagaaactcgcaaaaaaacgggcagtgggactcagaagaattcgcactcaccgaggctttcaaatccctcttcgtccggtatgagatcgattacaccgccgatctgaagacggcaatcgtcgacgagaaacagaaagacttctttgtagatctacttaagctctttaagctaaccgttcagatgcgaaacagttggaaagaaaaggatctcgactatctcattagtccagtggctggcgcggatggtagatttttcgatacccgggaaggtaacaagtcccttcccaaagacgccgacgcgaatggtgcctacaatattgcactaaaggggctctgggcgctgcggcaaattagacagacatctgaagggggcaagcttaagctggctatttctaataaagagtggttgcagtttgtgcaggaaaggagttatgagaaggactag

SEQ ID NO: 153 - DNA, 3792 bp, Artificial Sequence
  Description of Artificial Sequence: Synthetic polynucleotide
atgaacaacggcaccaacaacttccagaacttcatcggcatatcgtctctgcagaaaacacttaggaatgccctgattccaactgagacaacacagcagtttattgtgaagaatgggatcatcaaagaggacgaattgcgcggggagaataggcagatcctgaaggacatcatggacgattactacaggggttttatctccgaaacgctgagctcgattgacgatattgactggacgtccctctttgagaagatggaaatccaacttaaaaatggcgataataaagataccctgataaaggaacaaaccgaatatagaaaggctatacacaaaaaattcgcaaatgacgaccgctttaagaacatgttttctgcaaaactgattagcgatattctgcccgagtttgtgattcacaataataactattccgcttcggagaaggaggaaaagactcaggtgattaaactgttttctcggttcgccacttctttcaaagattatttcaaaaatcgcgccaactgtttttccgctgacgacatctcctcctcttcctgccaccggatcgtaaacgacaatgccgagatcttttttagtaacgcccttgtgtatcggaggatagtgaagagcctgtccaatgatgacataaacaaaatttctggcgatatgaaggatagcctcaaagagatgagccttgaagaaatttactcctacgagaagtatggggagttcatcacccaggaggggatttccttctataatgacatctgtggcaaggtgaacagcttcatgaacctgtactgccagaagaataaggaaaacaaaaatctgtacaagcttcagaagttacataagcagatcctgtgtatcgcggatacctcatatgaggttccttataagttcgagagtgatgaagaagtgtaccagtctgtaaatggattcttagacaatatttcgtccaaacatatagtggagagactgagaaagatcggggacaattacaatgggtacaatctcgacaagatttatatcgtgtcgaagttttacgaatctgtgagccagaaaacatacagggattgggaaaccattaataccgcgcttgaaattcactacaataatattctgcctggcaacggaaaaagcaaggccgataaggtaaaaaaggcagtcaaaaatgaccttcagaaaagtatcaccgaaatcaatgagttggtgagcaactacaaattgtgttcagacgataatattaaagcggaaacgtacatacatgaaattagccatattctgaataactttgaggcgcaggaacttaagtacaaccctgaaattcatctcgtcgaaagcgaattgaaggcctctgaattgaaaaacgttcttgacgtgataatgaacgctttccattggtgctctgtgtttatgactgaagagctggttgataaggacaacaacttttatgctgaacttgaggaaatctacgacgagatctaccctgtgattagcttgtataacctcgtcagaaactacgttacccagaagccgtacagcacgaaaaaaataaagctgaactttggtattccgactctcgccgatggatggagcaagtcgaaggaatattccaacaatgccatcattcttatgcgagacaatctgtattacctcggcatctttaacgccaaaaacaagccggataagaaaatcattgaagggaatacgagcgagaataagggcgactataagaaaatgatctacaacttactgccaggtcccaataaaatgattcctaaggtgtttctgtcatcgaaaacaggtgtagaaacatataagcccagcgcatacatcctggaaggctacaagcaaaacaaacacatcaaaagcagcaaggactttgatatcacattctgccacgatctaatcgactacttcaaaaattgcatcgccattcaccctgagtggaagaacttcggctttgacttctccgacaccagtacctacgaagacatttctggattctaccgtgaggttgagctgcagggttataaaattgactggacatacatcagtgaaaaagacatcgatctactgcaggagaaggggcagctctatctcttccagatttataataaggatttcagcaagaagtccactggaaacgacaatctgcatacaatgtatcttaagaacttgtttagcgaagagaatttgaaagatatcgttctaaagttaaacggggaagccgagattttctttcgaaagtcttccattaagaatccaattattcacaagaagggcagtatcctggtcaacagaacctatgaggccgaggaaaaggaccagttcggtaatatacaaattgtgcgcaagaacatccccgagaacatttaccaggagctctataaatacttcaacgacaaaagcgataaggagctttccgacgaggctgccaagctgaaaaacgtggtgggacaccatgaagcagccaccaacatcgtcaaagattatcgttatacatatgacaaatattttctgcacatgcctattacaataaactttaaggcaaacaagaccgggttcatcaatgaccggatactccagtacatcgcaaaagagaaggacctgcatgtgatcggcatcgaccgcggtgaaagaaatctcatttacgtcagcgttatcgacacttgtggaaacattgtggagcagaagtccttcaacattgttaacggctatgactatcagatcaagctcaaacagcaggaaggtgctcgtcagattgcgaggaaagaatggaaagagatcggcaagatcaaggagatcaaagaagggtatctgagcttggtcattcacgagatctccaaaatggtcatcaagtacaacgctattatcgcgatggaagacctctcttacggctttaagaaggggcgctttaaagtggagcgccaggtctatcagaagttcgagactatgcttatcaataagctgaattacttggtctttaaggatatcagtatcaccgagaacggaggactgctgaaaggttaccagctcacatatattcccgataagctcaagaatgtgggccaccaatgcggttgtattttttacgttccagctgcctacacatctaagatcgatcctaccaccggattcgtcaatatatttaaatttaaagatctaaccgttgatgccaagcgtgagtttattaagaaatttgattcaatcaggtacgacagcgaaaagaacctcttctgtttcactttcgactacaacaacttcatcacacaaaatactgtgatgagcaagtcatcatggagcgtttatacttatggtgtaaggataaaaaggcgctttgttaatggaaggttttccaatgaaagcgatacaatagacatcacaaaagacatggagaagacactggagatgacagatattaattggagggacgggcatgaccttagacaggacatcatcgactacgaaatcgtccaacacatttttgagatattcagactcactgtccagatgcgaaacagcctgtcggaactcgaagaccgggactacgatagactgatctccccggtgttaaacgaaaataatattttctacgattctgctaaggcaggagacgctcttcctaaagatgcggacgccaatggcgcttactgtatagcgttgaagggattgtatgagattaaacagatcactgagaattggaaagaagacggtaaattctccagagacaagctgaaaatctccaacaaagactggtttgattttattcaaaataagcgctacctgtaa

SEQ ID NO: 154 - DNA, 3957 bp, Artificial Sequence
  Description of Artificial Sequence: Synthetic polynucleotide
atgacaaacaaatttactaatcagtacagcctgtcaaagaccctccgcttcgaactgattccacaagggaagacccttgaattcatccaggaaaagggtttattatcccaggataaacaacgcgcagaaagctatcaagagatgaagaagacgatcgataaatttcataagtatttcatagatttagccctgagcaacgctaaattgacccacctggaaacctatttggagctgtacaacaagtcagccgagacaaagaaagagcagaagtttaaggacgacctgaaaaaagtacaggacaatttgcgaaaagagatcgtcaagtctttttccgacggagacgccaagtcaatatttgccatcctggacaaaaaggaactcatcactgtggagttggagaagtggtttgagaataatgagcagaaggacatctattttgacgaaaagttcaagacatttactacttacttcaccggatttcaccaaaaccggaagaacatgtactctgttgagccgaactcaaccgccatcgcctaccgccttattcacgaaaatctgccaaagtttctcgagaatgctaaagcctttgagaaaattaagcaggtcgagtcgctccaggtgaactttcgagagctgatgggtgaattcggggacgagggcctgattttcgtgaatgaactcgaagagatgtttcagatcaactactataatgatgtactctcacagaacgggatcactatctacaacagcattatctctggattcactaagaacgatatcaagtataaagggctgaatgaatacatcaacaattataatcagactaaggacaaaaaggacaggctgcctaaattgaaacagctgtataagcagatcctcagtgatagaattagcttgtcatttctcccagatgccttcactgacggaaagcaggtgcttaaggcgatattcgatttctataagatcaacctcctctcttatacaatcgagggccaggaggagtcacagaacctcctgctcctgattcgacaaactattgaaaatctgtcctctttcgatacgcagaagatatacctgaaaaatgacacccatctcactacaatatcccaacaggtattcggagatttctccgtcttcagtacagccctgaattactggtacgagacaaaggtgaaccctaagttcgaaacagagtacagcaaggcgaacgaaaagaagagggagatcctggacaaagccaaagccgttttcaccaagcaagattactttagcatcgcatttctgcaggaagtcctgtctgagtacatactgacactcgatcacacaagcgacatagttaagaagcactcttccaattgtatcgcggactacttcaaaaatcattttgtcgcgaaaaaggagaacgagacagataagaccttcgattttatcgcgaatattaccgcaaagtatcaatgcattcagggtatcttggagaacgccgaccagtacgaagacgagcttaaacaggatcagaagctcatcgacaacctaaagttctttttggacgctatactggaactccttcattttattaagccactacatctgaagagtgagtctatcactgagaaggacactgctttttacgacgttttcgagaattactacgaagcactgtctctgctaacccctctgtataacatggtgagaaactatgtgacacagaaaccttatagtaccgagaagattaagttgaacttcgagaacgcacaattgctgaatgggtgggatgcaaacaaagagggtgattacctcacaacaatcctcaagaaagatggcaattacttcctggccattatggataaaaaacataacaaggcatttcagaaatttcccgaggggaaggaaaattatgaaaagatggtatacaagttgctgcccggggtgaacaaaatgctcccgaaggtgtttttctcgaataagaatatcgcgtactttaacccgtccaaggaactgttggaaaattataaaaaggaaacacacaagaagggggacacttttaatttggagcactgccacacactcattgacttctttaaagatagtctcaacaaacatgaggattggaaatattttgactttcagtttagcgagaccaagtcttatcaggatctgtcgggattttatagggaagttgagcaccagggttacaagataaatttcaagaacatcgatagcgagtacattgacggactggtgaacgaagggaagctgttcctgtttcagatttacagcaaagatttctctcctttctcaaaaggcaagccgaacatgcataccctgtattggaaggccctgttcgaggagcaaaaccttcagaatgtgatttacaagctgaacggtcaggccgagattttttttaggaaggcctctatcaagcccaaaaacatcattctgcacaagaaaaagataaagatcgccaaaaaacacttcattgataaaaagacaaagacttctgagatcgtacctgttcagacaatcaagaatctcaacatgtattatcaggggaagattagcgagaaagagctgacacaggacgatttgaggtacatcgacaacttctctatctttaacgagaagaacaagacaatcgatatcatcaaggacaagcggtttaccgtcgataaattccagttccatgtgcctatcacgatgaatttcaaggccaccggtgggagttatatcaaccagactgtgctggagtatctgcagaacaaccccgaagtaaaaattattggcctggacagaggagagcggcatctggtgtacttgaccctcatcgatcagcagggaaatatcctgaaacaagaatctctgaatactattacggactccaaaatcagcacaccttaccacaagctgcttgataataaagagaatgagagggacttggcccgcaaaaattggggcaccgtcgagaatattaaggaattgaaagaaggatacatctcacaggtggttcacaaaatcgcaaccctgatgttagaagagaacgctattgtggtgatggaggacttaaacttcggatttaaaagaggaagatttaaagtcgagaaacagatttatcagaaactggaaaaaatgctcattgacaaattaaattacctggtgctgaaagataaacagccacaggagctgggtggcctgtataatgctctgcagctgaccaacaagttcgagtcgtttcagaaaatgggcaagcagtcaggcttccttttttacgtgcccgcttggaacacctcaaaaatcgaccctacaacaggctttgtgaattatttctataccaagtatgaaaacgtggacaaggcaaaggcctttttcgagaagtttgaagcaatcaggttcaatgccgagaaaaaatactttgagttcgaggtcaaaaaatatagcgacttcaaccctaaggccgaaggcacgcaacaagcctggacaatatgcacgtatggggagagaattgagactaagcggcagaaggatcagaataacaaattcgtgagcacaccgattaacctgacagagaagatagaggacttcctcggcaagaatcagatcgtgtacggcgacggcaattgcatcaagtcacaaattgcatctaaagatgacaaagcattcttcgaaacactgctgtattggttcaagatgacactccagatgcgaaatagcgaaacaagaacagatattgactacctcatcagccctgtgatgaatgataacggcacgttttacaattcccgggactatgaaaaattagagaacccgacactgccaaaagacgccgacgcaaatggtgcatatcacatcgcaaagaaaggtttgatgctgttgaacaaaattgatcaggctgatctgacaaaaaaggtcgatctgagtatcagtaaccgcgactggttgcagtttgtccagaagaacaaataa

SEQ ID NO: 155 - DNA, 4017 bp, Artificial Sequence
  Description of Artificial Sequence: Synthetic polynucleotide
atggaacaagagtactatctgggcctggacatgggcaccgggagtgtcggatgggcagtcaccgactcagagtaccacgtcctcagaaagcacggtaaggcactttggggagtgcgactcttcgagtccgctagtactgctgaagagaggaggatgtttcgaacttccaggcgcaggctggatcggcgaaactggagaatagagattctccaggagatatttgctgaagagatttcaaagaaggatcctggttttttcctgcgcatgaaagaatctaagtattaccccgaagataaacgcgacatcaacggcaattgtcctgaactgccctatgctctgtttgtcgacgacgatttcaccgacaaagattaccacaagaaattccccaccatataccacctgagaaagatgttgatgaacaccgaggagacacccgacatacgtctggtttacctggctatccatcatatgatgaagcaccgcgggcatttcctgctgtctggagacatcaatgagataaaggaatttggtactacgttctccaagttgttagaaaacattaagaatgaagagttggactggaatcttgaactgggaaaggaagagtatgcagttgtagagtcgattttgaaagataacatgttaaaccggtcaactaagaaaaccaggttaattaaggcactaaaggccaaatcgatatgcgagaaggctgtgctaaatctgctggctggaggcaccgtgaaactgtctgatattttcggcctggaagagctcaatgaaaccgagcggcctaaaatttctttcgccgataacggatacgatgactatattggggaggtggaaaacgagctcggagaacaattctacattattgaaaccgctaaggcagtctatgactgggccgtgctcgtcgagattttaggcaagtacaccagcattagcgaagcaaaggtggctacctatgaaaagcacaaatctgacctccagtttctgaaaaagattgtgcgcaaatacttaacaaaagaagagtacaaggacatctttgtgagcacatcagataagctcaagaattactcagcatacattggaatgacaaagattaacgggaagaaggtggatctccaaagcaaacgttgttcaaaggaggagttttacgatttcataaagaagaacgtgctgaagaaactggagggacaaccggagtacgagtatttaaaggaggagctcgagcgagaaactttcctgcccaagcaagtgaacagagacaatggtgtcattccttaccagattcacttatatgagctgaagaaaatcctggggaacttgagagacaagatagacctcatcaaggaaaatgaagataagttggtccagttgttcgaattcagaatcccatattacgtcggcccgctcaataagatcgacgacggcaaggaaggcaaattcacttgggcggtgcgaaaaagcaacgaaaaaatatacccatggaactttgagaacgtcgttgacatcgaggccagcgccgagaaatttataagacgcatgactaataagtgtacttacctcatgggcgaggatgttctgcccaaggacagcctgctgtattccaagtacatggtgcttaacgagctgaataatgtaaagttagatggtgagaagctcagcgtggagcttaaacagaggctgtacactgatgtgttttgcaagtatcggaaagttaccgttaagaagataaagaattacctgaaatgcgaagggatcatttccggcaacgtggaaattaccggaatcgacggcgattttaaggcgtcgttgaccgcttatcatgatttcaaggagattttaaccggcacggagctcgcgaagaaagacaaggagaacataatcacgaatatagttctgtttggggacgataaaaaacttcttaaaaaacgactcaatcgactgtatccgcagattacccccaaccagctgaagaagatttgcgctctgagctataccgggtggggccggttctctaagaaattcctcgaggagatcacagcaccagacccagagactggtgaggtgtggaatattattacagctctgtgggaatccaataataaccttatgcaattgttgagcaatgaatataggttcatggaggaagtggaaacctacaatatgggcaagcagacaaagaccctatcttacgagaccgttgagaatatgtatgtctccccttcagtgaaacggcaaatctggcaaactttgaagatcgtgaaggagctcgaaaaggtgatgaaagagagcccgaagagggtttttattgaaatggccagagagaaacaggagagcaagagaacagagtctaggaagaagcagctaatcgatttgtataaagcctgcaagaacgaggaaaaagactgggtcaaggagctaggcgatcaggaagaacagaagttgcgctctgataagctgtacttatattatacccagaaaggacggtgcatgtactcaggtgaggtcattgagctgaaagatctgtgggacaatactaagtatgatattgatcacatctaccctcagtcaaaaactatggacgactccctcaacaacagggtgttggttaagaagaaatacaatgctacaaagtccgataaataccctcttaacgaaaacatccggcacgaaagaaagggcttctggaagtccctgctggatgggggttttatcagtaaagaaaagtatgagaggctgatccgaaataccgagctctcccccgaggaactggctggctttatcgaaaggcagatcgtagagactaggcaatctacaaaggcagtcgctgagatcctgaagcaagtgtttcctgagtcagaaatcgtgtacgtcaaagctggcacagtgtcacggttccgaaaggactttgagttgttaaaagttcgggaggtgaatgacctgcaccacgctaaagacgcctatctgaatatcgttgtggggaactcctattatgttaagtttactaagaatgcgtcctggtttattaaggagaacccggggcgcacctataacctgaagaagatgttcacctccggctggaacatagaacggaacggagaagtcgcgtgggaggtgggtaagaaagggaccattgtgaccgtcaaacagattatgaacaaaaacaacatattggtaactcgccaggtgcatgaggccaaagggggcctctttgatcagcagattatgaaaaagggcaaaggacagatcgcaatcaaggaaaccgacgagcgcctggcatccattgagaagtacggaggctacaacaaggcggcaggtgcgtacttcatgctcgtcgagtccaaagataagaaaggcaaaactattagaacaatcgagttcatccctctatatttgaaaaataagatcgaaagtgacgaaagcatcgcccttaacttcttggagaagggccggggcttaaaggaaccaaagattctgctcaagaagatcaagatcgacacactcttcgatgtggatggttttaagatgtggctgtcaggcaggacaggggatcgcttgctgttcaaatgcgcaaatcagttgattctggacgaaaagatcattgtgacgatgaagaagatcgttaaattcattcagcggagacaggaaaacagagaactgaaactctccgataaggatggaattgacaatgaagtcctcatggagatttacaatacctttgtggacaagcttgagaacacagtctatcggatccgactgtccgaacaggcaaagactctgatcgacaaacagaaagaattcgaaagactaagcttagaggacaaaagttcaactctctttgaaattctccacatcttccaatgtcaaagtagtgcagccaacttgaagatgatcgggggtcccggcaaggctggaatcttagtcatgaacaacaacatctccaaatgtaacaaaatctccatcataaaccagtctcccaccggcattttcgagaacgaaattgatttactcaag

SEQ ID NO: 156 - DNA, 3858 bp, Artificial Sequence
  Description of Artificial Sequence: Synthetic polynucleotide
atgaaatctttcgattctttcaccaacctctactcccttagcaaaacccttaagtttgaaatgaggccggtggggaatacacagaagatgcttgacaatgctggcgtctttgaaaaggacaaattaatccagaagaagtatggtaaaacaaagccatattttgaccgattgcatcgggaattcattgaagaggctcttacaggagtagaattgatcggactggacgagaacttccgtaccttagtagactggcagaaggacaagaagaacaacgtggcaatgaaggcctatgagaactcactccagcgccttagaaccgagatcggaaagatctttaatcttaaggcggaagattgggtaaaaaataagtacccgatcctgggactgaaaaacaaaaacacagacatcctgtttgaagaagccgtctttggtatcttgaaggccaggtatggagaggagaaagacacgtttatagaggtagaggagattgataaaacaggcaagagtaagattaatcagatcagtatctttgattcttggaaggggttcacaggctactttaagaagtttttcgaaaccaggaaaaatttctataagaacgatggcacctccacagctatcgcgacacgcatcatagatcagaatctgaaacggttcattgataatctgagcattgttgaatccgtgcgccagaaggtcgacctagctgagactgagaagtctttctctatatcactctcccagttcttctcaatagatttttataataagtgccttctgcaagatggcatagactactataacaagatcatcggcggcgaaactctcaaaaacggtgaaaagctcattggcctgaatgagctcatcaaccaatatagacaaaataacaaggatcagaaaatcccattctttaagctgctagataaacagatcctatcagaaaaaatcctgttcctcgacgaaatcaaaaacgacaccgaactcatcgaggctctctcgcagtttgccaagacggctgaggagaagacgaagattgtgaaaaagctgtttgcagactttgtggagaacaactctaaatacgatttggctcagatttatatctcccaggaagcatttaacacaatctccaataagtggactagcgagactgaaaccttcgccaaatacctgttcgaggccatgaaaagcggcaagctcgccaaatacgagaagaaggacaattcctataagtttcccgatttcatcgcattatctcagatgaagtccgcgctacttagcattagcctggaaggccatttttggaaggagaaatactataagatttccaaattccaagaaaagaccaattgggagcagttcttggctatttttctatacgagttcaactctttgttcagtgacaagatcaacactaaggacggtgagaccaaacaagtggggtactacctcttcgccaaagatcttcataacctgatactgtccgaacagatcgacatacccaaggattcaaaggtgaccatcaaggattttgcggattcggtattgacgatctatcagatggcgaagtatttcgctgtcgagaaaaagcgggcatggctggccgaatacgagttggactccttctatactcaacccgatacagggtacctgcagttttacgataatgcatacgaggatatagtccaggtgtacaataaactcaggaactacctcactaagaaaccatactccgaagaaaaatggaaacttaattttgagaatagtacactggccaatggatgggacaagaacaaggaatcagacaactccgctgtaattctccagaagggtggcaagtattatctgggactgataacaaagggccataacaagattttcgatgaccgttttcaggagaagtttatagtgggcatagagggtggcaagtatgaaaaaatagtctacaagttctttcccgatcaggcgaagatgttccccaaagtatgcttcagtgctaaaggcctcgagtttttccggccatctgaagagatactccgcatctataataacgcagagtttaaaaagggagagacgtactcaatcgactcgatgcagaaactcattgacttctacaaagattgtctcacaaaatacgagggctgggcttgctacacgtttcggcacttgaagccaaccgaggaatatcaaaacaacatcggggagttcttccgtgacgtcgccgaagacggctatagaattgactttcagggcataagtgatcagtatattcacgagaagaatgagaaaggtgagttgcatcttttcgaaatccacaataaagactggaatcttgacaaggctcgcgatggaaaatcaaagactacccagaagaatcttcatacactttacttcgagtccctcttttccaacgacaacgtcgtacagaatttcccaataaaactgaacggccaggccgaaattttttacaggcccaaaaccgaaaaagataaactggaatccaagaaagacaagaagggaaataaggtgatagatcacaaaaggtattccgagaacaagatttttttccacgtacctcttaccctgaacagaacgaagaacgactcttatagattcaatgcccagataaacaactttctcgcaaacaacaaagatatcaatattatcggcgtcgatagaggtgagaagcacttggtatattattctgtgatcacgcaagcatccgatatcttggagtccggttctttgaacgaactgaatggtgtcaactacgccgagaaactcggtaagaaagctgagaatcgggagcaggctagaagggactggcaggacgttcagggtatcaaggacctgaagaagggctacatttctcaggtggttcgaaaactggctgatttggccattaagcacaatgcaatcatcattttagaagatttgaacatgcggtttaaacaagtcaggggggggatagagaaatcaatttaccaacagctggaaaaagctctgattgataaactctcttttttggttgataagggcgaaaagaaccccgagcaagcaggacatctccttaaagcctatcaactgagcgcacctttcgagacattccagaagatgggaaagcaaaccggcatcattttctatacccaggcttcctatacatccaagtctgatccagtgactgggtggagaccccatctctacctcaagtacttttctgccaaaaaagctaaggacgacattgctaagttcacaaaaatcgagttcgtgaacgacaggttcgagctgacttatgacataaaagatttccagcaggccaaggagtacccaaacaagacagtttggaaagtgtgttccaatgtggagaggtttcggtgggacaagaatctgaatcagaataaagggggatatactcactacaccaacattaccgagaacatccaagagttgttcaccaaatacggcatcgacattactaaagatctgctgacacagatctccaccatcgatgagaagcagaacacatctttcttccgggatttcatcttttattttaacttgatctgtcagattagaaataccgacgacagtgagatagctaaaaaaaacgggaaagacgatttcattctctctcccgtggagccgttttttgactcccgcaaagacaatggcaataagcttccggaaaacggggacgataacggcgcctacaacatcgctcgtaagggaatcgttatcctcaataaaataagccagtattccgagaagaacgagaattgtgaaaaaatgaagtggggggacctttacgtcagcaacatcgattgggataactttgtgacacaagccaatgcgagacactag

SEQ ID NO: 157 - DNA, 3465 bp, Artificial Sequence
  Description of Artificial Sequence: Synthetic polynucleotide
atggaaaacttcaaaaacctctaccccatcaacaagaccttgaggtttgagctccggccatatgggaagacactggagaacttcaaaaagtccggtctgctggaaaaggatgcttttaaggctaactctaggaggtctatgcaggccattatcgatgagaaattcaaggagaccatagaggagcgtctgaaatatactgagttttccgagtgtgacctaggaaatatgaccagtaaggacaaaaagatcaccgacaaggcagcgacaaacctgaagaaacaggtgattttaagctttgatgatgagattttcaataactacttgaagccggacaaaaacatcgacgctctgttcaagaatgatccaagcaacccggtcatctctactttcaagggcttcaccacatactttgtaaatttcttcgaaatacggaaacacatcttcaagggagagtcttccggtagcatggcttacagaataatcgatgagaacctaactacatatctaaacaatatcgagaagatcaagaaattgcctgaagaactgaaatctcagcttgagggaatcgatcaaattgacaaactgaacaactataacgagttcatcacccagtccggcattactcattataacgaaattattggagggatttcgaagtctgaaaatgtcaaaattcaaggcattaacgaagggattaatctttactgtcaaaagaataaagtgaagctaccacgcttaactcctctgtataagatgattctctctgatcgggtctctaattcctttgtgctggataccattgaaaatgataccgagttaattgaaatgatctctgatctgataaataagacagagataagtcaggatgttattatgtccgacatccaaaatattttcatcaaatataaacaactcggcaacttgccggggattagctactcatctatagtgaatgctatctgttcggattacgacaataactttggtgacggcaaacgtaaaaaaagctatgagaatgatcgcaaaaaacacctcgagactaacgtgtatagcattaactatatctcagagttactgacagacaccgacgtctccagcaacataaagatgcggtacaaagagctggagcagaattatcaggtatgcaaggaaaatttcaacgccactaactggatgaacatcaaaaacattaagcagtctgagaaaaccaatctgatcaaggaccttcttgacatcctcaagagcatccagcggttttatgatttgtttgacatcgtggatgaagacaaaaatcctagtgctgagttctatacctggctgtctaaaaacgcggagaaactggacttcgagtttaattcagtgtacaacaagagcaggaactacctcacgagaaagcagtactccgataaaaagattaagttgaacttcgatagtcctactctcgccaaggggtgggatgcgaacaaagaaattgataatagcacaattatcatgaggaagttcaacaacgaccggggcgattacgattacttcttggggatctggaataagagcacacctgccaacgaaaagatcatcccattagaggataatggactgtttgaaaaaatgcaatataagctgtatcccgatcctagtaaaatgctgccaaagcaattcctttctaagatctggaaagctaaacatccaactacacccgagtttgataagaagtacaaagaaggtcggcacaagaaggggcctgattttgagaaagagtttctgcacgagttgatcgattgctttaagcatggattggtaaaccacgacgaaaaatatcaggatgtgttcgggttcaatctgcgcaacacggaagactacaactcttatacagagtttctggaggacgtcgaaaggtgcaactataatcttagtttcaataaaatcgctgacacgtctaacttgataaatgatgggaaactctatgtttttcagatctggagcaaggatttcagcatagatagcaagggaacaaaaaacttgaacacaatatactttgaatccctcttctcggaggaaaatatgatcgagaagatgttcaagctctcaggggaagccgaaatattctatcgtccagcaagtttgaattattgtgaagatattatcaagaagggacaccaccacgccgaactgaaggacaaattcgactatcccatcatcaaggacaagcgatatagccaggacaaatttttttttcatgtccccatggttatcaactacaaaagcgagaagttaaactccaaatcacttaacaataggacgaacgaaaatttaggccaattcacgcacatcatcggtatcgaccgcggagagcgacatctcatctacctgaccgtggtggatgtgtccaccggtgagatcgttgagcaaaagcacctggatgaaattataaatacagatacaaaaggcgtcgagcataaaactcattatctcaataaattagaagagaagtccaagacgcgggataatgaaagaaagtcctgggaagcaatcgagacgattaaggagctgaaagaaggctatattagccacgtgatcaatgaaatccagaaattgcaggaaaagtataacgcactgatagtgatggagaacctcaattatgggtttaagaactcgcgtatcaaagtggaaaagcaggtctaccagaaattcgagaccgccctgattaaaaagtttaattacatcattgacaagaaagatcctgaaacctacattcatggataccaactgacgaatccaatcactacactcgataaaattggtaaccagagcggtattgtgttgtacattccggcttggaatacaagcaagattgatccagtcactggtttcgttaacctcctgtatgcagacgatttgaaatacaagaaccaggagcaggctaaaagctttatccagaaaatcgataatatctacttcgaaaatggtgagtttaaatttgatatagatttcagcaaatggaacaaccgctactcaattagcaagacgaaatggacactgacaagctacggaacccggatacagacgttccgaaacccccagaaaaataacaagtgggacagcgccgagtatgacctgaccgaagagtttaaattaatcctgaacatcgatggtactctgaaatctcaggatgtggaaacctataagaaattcatgtctttattcaagctgatgttgcagctgcgaaactccgttactggaacagacattgactacatgattagccctgtgacagataaaactggaacccactttgattcacgggagaatatcaagaacctgcccgccgatgctgatgcgaacggagcttacaacattgctaggaagggcatcatggcaatcgagaatattatgaacggcattagcgaccctctgaagatcagtaatgaggactacctgaagtacattcagaaccaacaagagtaa

SEQ ID NO: 158 - DNA, 3924 bp, Artificial Sequence
  Description of Artificial Sequence: Synthetic polynucleotide
atgacccagtttgagggtttcaccaatctttatcaggtgtcaaaaacactcagatttgagctcatcccacagggtaaaactttaaagcatattcaagagcagggctttatagaggaagacaaagccagaaacgaccattataaggaactaaaaccgatcattgaccgcatctacaaaacctatgccgaccaatgccttcagctcgtccaactcgattgggagaatctgagcgccgctattgacagctacaggaaggagaagaccgaggagactagaaacgccctgatcgaggagcaggcgacctatagaaacgctattcacgattattttatcggccgcaccgacaatttgacagatgccatcaacaagcggcacgccgaaatttataaggggttatttaaggccgagctgttcaatggaaaagtactgaaacagctgggcaccgtaacaaccaccgaacacgagaatgctctgttgaggtccttcgacaagtttactacctactttagcggcttctacgaaaaccgtaaaaacgtgttttccgcggaggatatttcaacagccattcctcataggatcgtgcaggataatttccccaagtttaaggagaactgccatatctttaccagacttatcactgctgtgccaagtttacgagaacacttcgagaatgttaagaaggctataggcatattcgtttccacctccatcgaagaagtattcagttttccattctacaatcagttactcacgcagacccagatagatctctacaatcagctgctcggaggcatttctagagaagcaggcacggaaaagatcaagggcttaaatgaagtactcaatcttgcaattcagaagaacgatgagacagcacacattattgcatctctccctcacagattcattcccctgttcaaacagatcctgtccgatcgcaacacactaagctttatacttgaggagtttaagtcagatgaggaagtgatccagagcttctgtaagtataagactttgctccgtaatgaaaacgtgcttgagacagcagaggctctctttaacgagttgaattccatcgacctgacacacatttttatcagccataaaaagctggaaacgattagctctgccttgtgcgaccactgggacaccctgcgtaacgccctctatgaaaggcgcatttccgagctcaccgggaagatcacaaaaagtgccaaggaaaaagtccagaggtcccttaaacatgaagacatcaacctacaagagatcatctctgcggctgggaaagagctgtcagaagcatttaaacagaagacttccgagatcctgagccacgcacacgccgcattagaccagcccctgcctacaactcttaaaaaacaggaggagaaggagattttaaagagccagctggactcattactcggcctgtatcatctcctggactggttcgccgtggacgaatccaacgaggtggacccagaatttagcgccaggctgacaggaattaaactggaaatggagccaagtttgagcttttacaacaaggctcggaactatgccactaaaaagccctacagcgtggaaaagttcaagctgaattttcagatgccgaccctggcttccgggtgggatgttaataaggaaaagaataatggggctatactgttcgtcaaaaatggtctctactacctgggaatcatgcccaaacagaagggcaggtacaaagccctttcgtttgagccgaccgaaaaaaccagcgaaggctttgataagatgtattacgactatttcccagatgcagccaagatgatcccaaaatgtagcactcagttgaaggcggtaaccgctcactttcagacacacaccactcctatcttgctctccaacaactttattgagccgctggagatcacgaaggaaatctacgaccttaacaacccagagaaggaacccaagaaattccaaacagcttatgctaagaagactggggatcaaaagggctatcgagaggctttgtgtaagtggattgactttacacgggatttcctgagtaagtataccaagaccacatctattgacctgtcctcactgagaccttcctcacaatataaggatctcggagagtattatgccgaactcaaccctctactctatcacatctctttccagaggatcgccgaaaaggaaattatggacgccgtcgagacaggcaagctgtacctcttccagatttacaacaaggatttcgcaaagggccaccacggaaaacccaatttgcacactttgtactggacagggctcttctctcccgaaaatttggccaaaacttcaataaaactgaacgggcaagccgagctgttctatcggcccaagtcacgtatgaagcggatggcccaccggctgggcgagaagatgctcaacaagaaactgaaggatcagaagacgcccataccagacactctttaccaagagctgtatgactacgtgaatcacagactgagtcacgacctgtctgatgaagcccgggctcttcttccaaatgtgattaccaaagaagtttcccacgaaattatcaaggaccggcgcttcacctctgacaaattctttttccacgtcccaatcaccctcaactaccaggcagccaattccccttcaaagtttaaccagcgtgtgaatgcctacctgaaagagcatccggagacccccatcatagggatagacagaggagagcggaatcttatctacattactgtgattgacagcacaggtaagatcttggagcagagatctttaaatacaatccagcagtttgactaccagaagaaactggataaccgagagaaggaaagggttgctgcaagacaggcctggtcagtggtcggcaccatcaaagacctgaagcagggctacttatcccaagtaattcacgaaattgtcgatcttatgattcattatcaagccgttgttgtgctggagaacctgaattttggcttcaaaagcaaacgaacaggtatcgccgagaaagccgtgtatcagcagttcgaaaagatgctcatagacaagctgaactgcttagtgctgaaggattatcctgctgagaaggtcggcggcgtacttaacccataccagctgaccgatcagttcactagtttcgccaagatgggaacgcaaagtggcttccttttctacgtgcccgctccctacacgagtaagatcgaccctctgaccggcttcgtcgacccattcgtctggaagaccatcaagaatcacgaatcacggaaacacttcttagaggggtttgacttcctgcactacgacgtgaagacaggggacttcatcttacactttaagatgaatcgaaacctctccttccagcggggcctgcctggtttcatgcccgcatgggacatcgtgtttgagaaaaacgagacacagtttgacgctaagggaaccccctttattgcggggaagcggattgtcccagtcatcgaaaaccatcggttcaccgggcgataccgggatctgtacccggccaacgagctcatcgcgctgctggaggagaagggtattgtgtttagggatggatccaacattctgcctaagttgctggaaaatgatgattcgcacgccattgataccatggttgcactgattagatccgtactgcagatgaggaatagcaatgctgcaaccggggaggattatattaattccccagtgcgagatctgaatggtgtctgttttgactcgcgctttcagaatccagaatggccaatggatgcagacgctaacggggcgtaccacattgctctgaaaggccagctactcctgaaccacctcaaggagagcaaagatctgaagctgcagaacggcatttccaaccaagactggctcgcctacatacaagaactgcgcaattaa

SEQ ID NO: 159 - DNA, 3390 bp, Artificial Sequence
  Description of Artificial Sequence: Synthetic polynucleotide
atggctgtcaaatccatcaaggttaaattacggcttgatgacatgcccgagatccgcgccgggctctggaaactccataaagaagtgaatgctggcgttagatactacacagaatggctctccctgctgcgccaggaaaatttgtaccgccggtcacctaatggagatggagagcaggaatgcgataaaacagcagaagagtgcaaagccgaattgctggagcgactgcgggcacggcaggttgagaatggacaccgaggtccggcgggatcggacgacgagctgctccagctcgccagacaattatatgaactgctggtgcctcaggctattggggcaaagggtgacgcacagcagattgctagaaaatttctgtctcccctcgccgacaaagacgctgtcggcggccttgggatagccaaagccggcaacaaaccccgatgggtgcgcatgagggaggctggtgagcctggctgggaggaagaaaaggaaaaggccgaaaccagaaagtccgccgacaggaccgcggacgtactccgagcattggccgattttgggctgaagcccttaatgcgagtctacaccgatagtgaaatgtctagcgtggagtggaagccattacgcaaagggcaggcagtgcggacgtgggaccgtgacatgttccagcaagccatcgagcgaatgatgagctgggagagctggaaccagagagtggggcaggagtatgccaagctggtcgagcagaaaaaccggtttgagcaaaaaaattttgtaggtcaggaacacctggtgcatctcgttaaccagctccagcaagatatgaaggaagcttcgcctggattagagagcaaagagcagactgcacactatgtaaccggaagagcactgaggggcagtgacaaagtgttcgaaaaatggggaaaactggctcccgatgccccctttgacctgtacgacgcagaaataaaaaacgtgcagcggcgaaacaccaggcgatttggtagccatgatctgttcgccaaattggcagagccggaatatcaggctctttggcgagaagacgcatcatttctcactaggtacgcggtctataactccattttgaggaaattgaaccacgcaaaaatgtttgccaccttcacgttgcctgacgccaccgctcatcccatttggacacggtttgataagctgggcggcaatctgcatcagtatacattcctgtttaacgagtttggagagcgaagacatgcgatacgattccacaagctactgaaggtcgaaaatggcgtggcacgtgaggtggacgatgtcaccgtgcccatcagcatgagcgaacagctggataatttgttgccgcgggacccaaatgaacctatagccctttattttagggactacggggcggagcaacatttcactggggagtttggcggcgcaaaaattcagtgccgacgcgaccagctcgcccacatgcatagaagacgcggggcccgggacgtataccttaacgtctctgtgagggtgcagtcccagtcagaggcaagaggggaacgcagaccaccttacgcagcagtattcaggctggtaggcgataaccaccgggcgtttgtacactttgataaactttctgactacctggccgaacacccggatgacggcaaattaggatcggaggggctgcttagcggcctgcgtgtgatgagcgtcgatctggggctacggacctctgcttccatctctgtgttccgtgtggcccgaaaggacgagttgaaacctaattcgaagggccgtgtaccattctttttccctattaagggaaatgataatctcgtcgcggtgcacgagcgttcccaactgctgaaactgcctggcgagaccgagtccaaagatctcagagcaatccgggaggagcgacaacgtacacttaggcaactccgcacccagctggcctatctgcgcttgctggtgcggtgcggctccgaggatgtagggagaagagagcgaagctgggcaaagctgatagagcaaccagttgacgccgcgaatcacatgacccccgactggcgcgaagcgtttgaaaatgagctgcagaagttgaaatctctgcatgggatttgctcagataaggagtggatggacgccgtatacgagtctgttcgccgggtatggcggcacatggggaagcaggtgagagattggagaaaggacgttcgctctggggaacggccgaaaattcggggatacgcaaaggatgtcgtgggcggcaatagcattgagcagatcgagtacctggaaaggcaatacaaatttctgaaatcttggtctttctttgggaaggtaagcggacaagttatcagagccgaaaagggatctcgctttgctatcacattgagggaacacattgatcacgccaaagaagacaggttgaaaaagttggctgatcgcattatcatggaagcactcggttacgtctacgcccttgatgagcgcggtaaagggaagtgggtagccaagtatcccccatgtcagctgatcctgctcgaggaactttctgagtatcagttcaataacgaccgtcctccctccgaaaataatcagctcatgcaatggtcccaccggggtgtgttccaagaactgatcaatcaggctcaggtgcacgacctcctcgtaggcactatgtatgcagcctttagctcccgttttgacgcgcgcacaggcgcccctggaatacgatgtaggcgagttcccgcacggtgcactcaagaacataacccggagcctttcccatggtggctcaataagtttgttgtggagcataccctcgacgcttgcccattgagggcggatgacttgattcccacaggcgagggggagatcttcgtgagcccattttctgccgaagaaggggatttccaccaaatacatgccgacttgaatgctgcccaaaatctgcagcaaaggctgtggtcagacttcgacatctcgcaaatcagactgcggtgtgactggggcgaagtagacggcgagctggtgctgatacctagactgacgggtaagcgtaccgccgatagctatagtaataaggttttttatacgaatacgggggtgacatattacgagcgtgagagaggcaagaagcgtcggaaggtgttcgcgcaggagaagctgagcgaagaggaggcggagctactggtagaggcagatgaggcaagagaaaagtccgtcgtcctgatgcgggatcctagcgggattattaacagaggtaattggacacggcagaaagaattctggagcatggtgaatcaaagaatcgagggttacctggtgaagcaaattcgaagccgggtgccccttcaagacagcgcatgtgaaaacactggggacatctag

SEQ ID NO: 160 - DNA, 3327 bp, Artificial Sequence
  Description of Artificial Sequence: Synthetic polynucleotide
atggctactcggtccttcatcctgaaaatcgagccaaatgaagaggtgaaaaagggcctgtggaagacccatgaggtacttaaccacggcatagcatactatatgaatatcctaaaacttatacggcaggaggctatctacgagcatcacgagcaagatcctaaaaatccaaagaaggttagtaaggctgaaatccaggctgaattgtgggacttcgtgctgaagatgcagaaatgcaacagtttcacgcatgaagttgataaggacgtcgtgtttaatatactccgggagctgtacgaagaactggtaccaagctctgtggaaaagaaaggagaggccaaccagctaagtaataagttcctctatcctctcgtggaccccaattcacagagcggcaaaggtaccgcatcttctgggaggaaaccacgctggtacaacttgaagatcgctggcgatcccagctgggaggaggaaaagaagaaatgggaagaggataaaaagaaagaccccctggccaaaatcttaggcaagctcgccgagtacggtctgattccacttttcatcccgttcacagatagcaatgagccgatcgtcaaggagattaagtggatggaaaagagccgcaatcagagtgtgcggaggctggacaaagacatgtttattcaggccctggaacgcttccttagctgggaaagctggaacctgaaggttaaggaagagtacgaaaaagtcgagaaggagcataagactttggaggagcgcatcaaagaagacatccaggcctttaagtctctagaacagtatgagaaagaacggcaggaacagctgctgcgtgatacactgaacacaaacgaatatcgcctgagcaagaggggactcagaggctggagagaaatcattcaaaagtggctcaaaatggatgaaaatgagccgtctgaaaaataccttgaagttttcaaggactaccagcggaagcaccctagagaagccggcgactatagtgtttacgaattcttgagcaagaaggagaatcattttatatggaggaatcacccggagtacccatatctgtacgcaaccttctgcgaaatcgacaagaaaaaaaaagacgccaagcaacaggctacatttactctggccgaccctatcaatcaccctctatgggtccggtttgaggagcgctccggaagcaatctgaataaatatcgtattctgactgaacagttacacacagagaagctcaagaagaaacttacggtgcagctggaccgcctgatatacccaacagagtccggaggatgggaagagaaaggaaaggttgacatcgtactgcttccatctcgtcagttttacaaccagatattcctggacatcgaggagaaggggaaacacgccttcacatacaaggacgagtccataaagttcccactgaagggtactttaggcggtgctagggtgcagttcgaccgcgatcacctgagacggtacccccacaaggtggagagcgggaacgtgggacgaatctactttaatatgacagtgaacattgaacccacagagagtccagttagtaaatccctgaaaattcaccgtgacgactttccgaaatttgtgaatttcaagccaaaggagcttacggagtggatcaaggattcaaagggaaagaagctgaaatctggtatcgaatctctcgagatcggtctccgtgtcatgagcatcgatctgggacagcgccaggcagctgccgccagtatattcgaggtggtagaccaaaagcctgacatcgagggaaagctcttcttcccaatcaaaggcacagagctgtatgcggtgcaccgggcgtcctttaatataaagctgcccggtgaaaccctggtgaagtcacgggaggtgcttagaaaagcgcgagaggataacctcaaactgatgaaccaaaaactgaactttctgaggaacgtcctgcactttcagcagttcgaagatattaccgaacgcgaaaagagagtaaccaagtggatatctcgtcaagagaacagcgacgtcccgttagtctatcaggacgaactcatccaaatacgggagttgatgtataagccctacaaggattgggtcgcctttcttaagcagcttcacaaacgcctagaggtcgaaataggtaaagaggtgaaacattggcggaagtcgctcagcgacgggaggaagggactttatggcatctctttgaagaacattgacgaaatcgatagaaccagaaaatttttgttgagatggtccctccgacccaccgagcctggagaggtgaggcggttagaaccaggacagaggttcgctatcgatcagctgaatcacctcaatgctctgaaggaggaccgcctcaagaaaatggccaatacaatcataatgcacgcccttggctactgctacgacgtccgaaagaagaagtggcaggccaagaatcccgcctgtcaaattatcctttttgaggatcttagcaattacaacccctatgaagagcggtccagattcgaaaatagtaagctcatgaagtggagccgcagggagatcccgcgccaagtggcccttcagggggaaatttatgggctgcaggtaggcgaggtcggggcccaattctcctcgcgctttcatgcgaaaactggaagtcctggaatccggtgctcagtggtgacaaaggagaagttgcaagacaatcggttttttaaaaacttacagcgggagggaaggctgaccctggataagatagccgtacttaaggaaggagatctgtaccctgacaaaggcggtgaaaagttcattagcttgagcaaggaccgaaaacttgtgaccacccacgctgacatcaatgcggcacagaacctgcagaagagattttggactcgcacccacggattctacaaagtttactgcaaagcatatcaagtagacggacagaccgtatacatccccgagtccaaagatcagaagcagaaaattattgaagagtttggggaagggtactttatcctgaaggatggtgtctacgaatggggcaacgctggtaaacttaaaattaagaagggcagctctaaacagtcctccagcgagttagttgattctgatattctgaaagacagtttcgacctggccagcgaacttaaaggggaaaaattaatgctgtaccgggaccccagcggaaacgtctttccatccgataagtggatggccgctggagtgttctttggcaagttagagaggattctcataagtaagctgaccaaccaatactcaatctccacaatcgaggatgactcatccaagcagtctatgtga

SEQ ID NO: 161 - DNA, 3450 bp, Artificial Sequence
  Description of Artificial Sequence: Synthetic polynucleotide
atgcctacacgcactatcaacctgaaactggttcttggcaagaatccagagaatgctacccttcgtcgggcactattttcaacgcatagactggtgaatcaggctaccaaacggattgaagagttcctcttgctttgtcggggggaagcatataggacggtggataatgaggggaaagaggctgaaattccgagacacgccgtgcaggaggaagctcttgcgtttgcaaaggccgctcaacggcacaatggttgcatctctacttatgaagaccaggaaatcctggatgtgctccggcaactgtatgaaaggctggtgccttctgtgaatgaaaataatgaagcaggggacgctcaagccgcaaacgcgtgggtgtcgccactgatgtccgccgagtccgagggagggctcagcgtttacgacaaggtgctggacccacccccagtgtggatgaaactcaaagaggaaaaagctccgggctgggaggctgcttcccagatctggatccagtccgacgaagggcagtcccttcttaacaagcctggttcgcccccgcggtggattaggaaactgaggtcaggccagccttggcaggacgattttgttagcgaccagaaaaagaagcaggacgagctgacaaaggggaatgcgccactgatcaaacaattaaaggaaatgggcttattgcctcttgtgaatcccttttttagacatctgcttgacccggaggggaagggggtgtcaccttgggacagactcgctgttagggccgctgtcgctcatttcatatcatgggaatcatggaaccaccggacacgcgccgaatacaatagtttgaagctgcggagggatgagttcgaagcagcttccgacgaattcaaggacgacttcacgctgcttcggcagtacgaggctaagaggcactccacactgaagagtatagctttagccgatgattcaaacccttataggatcggcgtacgctccctccgcgcttggaaccgcgtccgcgaggagtggatcgacaagggagcgaccgaggagcagcgggtcaccattctcagcaagttgcagacccaactaaggggcaaatttggagatcctgacttgttcaactggctggcgcaggaccggcacgtgcacctctggagccctagagatagtgttaccccactggttaggatcaacgctgttgacaaagtattgcgacggagaaaaccgtacgccttgatgacttttgcccacccaagattccaccctcggtggatactttacgaagccccagggggcagcaatctccgccagtatgcactggattgtaccgaaaatgctctgcacattacactgcctctgctggttgacgatgcacatggcacatggattgagaaaaaaattagggttcctcttgcccccagcggccagattcaggacctgacactagaaaagctcgagaagaagaaaaatcgtctctactaccgttctgggttccagcagtttgccggcctggccggaggtgccgaggtgcttttccatcgaccatacatggagcacgatgagaggagcgaggagagcttattagaacgccctggtgctgtttggttcaaactcaccttggacgtggcaacccaggcccctccaaactggttggacggaaagggccgcgtccgaacgccccccgaggttcaccacttcaagacagccctcagtaacaagtctaagcacacacggaccctccagcccggactcagagtgttatccgtggatctgggaatgcgcaccttcgcctcttgctccgtatttgagctgatcgagggcaaaccagagactggcagagcgttccctgtggccgacgaacgttccatggattcaccaaacaagctgtgggccaagcacgaaagatcctttaaactcacgctccccggcgaaacccccagtcggaaagaagaggaggaacggagcattgcaagagccgaaatctatgcgttgaaaagagatattcagagattaaaaagtcttctgcgcctgggggaagaggataacgataatagacgcgatgcacttcttgagcaatttttcaagggctggggcgaggaagacgtggttccaggtcaggcctttccccggagtctgttccaggggctgggggccgccccattcagatccacccctgagttgtggagacaacactgtcaaacctattatgataaagcagaggcgtgcctggctaaacacatcagcgattggcgcaagagaaccaggcctaggcctacctcacgtgagatgtggtacaagacacgctcttatcacggcggaaagtcaatctggatgctggaatacctcgacgctgtgaggaaactgctcttatcctggagcctcagaggccggacctacggggctatcaacagacaggacacagcaaggttcgggagcttagccagccggctccttcaccacattaactcactcaaagaggatcgaataaagaccggagccgactcgatcgtgcaggcagcccgagggtacatccccctgcctcatgggaagggctgggagcagcgatatgaaccctgccagctgatcttgtttgaggaccttgcccgttatagatttcgcgttgatagacctcgccgtgagaattctcagctgatgcagtggaaccacagagcgatcgtggctgagaccactatgcaggccgagctgtatggacagatcgtggagaacaccgccgcagggttcagttctcggtttcatgctgccaccggagctcccggcgtccggtgccgcttcctcttagagcgtgattttgacaatgacctcccaaagccctatctgctgagggaactgagctggatgctggggaacacaaaagtagaatcggaggaggagaagctacggctcctctccgaaaagatacgtccaggctctctggtaccatgggacggaggagagcagttcgcgacactgcatcctaagagacagacgttatgtgtgattcacgccgatatgaacgccgctcagaatctgcagcgaagattctttggccgctgcggcgaagccttcaggctggtatgtcagccccacggggatgatgtgctgcggctggcctcaacccctggggctagactcttgggggcactccagcagctggaaaatggccaaggggctttcgaactcgttcgggacatgggcagcacaagccagatgaacagattcgtcatgaagagcctgggaaagaaaaagatcaaacccttacaggacaataatggcgacgacgaactggaggacgtgttgtccgtgctgccagaggaagacgacacaggccgcatcactgtcttccgcgactcaagtgggatattctttccttgcaacgtgtggattccggccaaacagttctggcctgccgtcagagccatgatttggaaagtgatggctagtcattcattgggatga

SEQ ID NO: 162 - DNA, 3759 bp, Artificial Sequence
  Description of Artificial Sequence: Synthetic polynucleotide
atgacaaagctgaggcacagacaaaagaagcttacacacgactgggcagggagcaagaaacgtgaggtccttgggtcaaatggaaaactgcagaaccccttgctcatgcctgtaaagaaggggcaggtaacagaatttagaaaagcattctccgcgtacgctcgggcaactaagggggaaatgaccgatggacggaagaacatgttcacccattctttcgagccattcaaaacaaagccgtcattgcaccaatgcgagctggccgataaggcttaccagtctttgcatagttacctccccggttccctggcccatttcttgctttccgcacacgcactgggctttcgtattttctctaaatctggggaggcaactgccttccaggccagctcaaaaatcgaggcctatgagtccaagctcgcttcggagctagcctgtgtcgatttgagtatccagaatttgacgattagtactcttttcaacgctctcacaacttcagttcggggcaagggggaggaaacttcagcagatccccttatcgcacggttctacactctcctgacgggcaagcccctgagccgagacacacagggcccagaacgggacttggcagaggtcatctccagaaagatcgcctcgtccttcggcacatggaaggaaatgactgccaaccctctgcagagcctccagttcttcgaagaagagcttcatgcactagatgccaacgtgtctttatctccagcttttgatgtgttaatcaagatgaatgatctccaaggtgatctgaagaaccgtactatagtgttcgacccagatgcacccgtgttcgagtacaacgctgaggatccagccgatatcatcataaagctgacagctcggtatgcgaaggaggccgtcatcaagaatcagaacgtgggcaattatgtgaaaaacgccattaccaccactaatgccaatgggctggggtggctcctcaataaagggctttcactactgccagtttctactgacgatgagctgctcgaattcattggggtggagagaagccatcccagctgtcacgcgctgatagagctgattgcccagctagaggcgccggaactgtttgagaagaatgtgtttagtgacacccgttccgaggttcagggtatgatcgacagtgcagtgtcgaaccacattgctcggctgtccagcagccgaaactccctgagcatggacagcgaggaattggaacgcttgattaaatctttccagattcatactccccattgttctctgttcataggcgctcagtccttatctcagcagctggagagcttacctgaggcgctgcagtccggagtgaacagcgctgatatcttattaggcagcacacagtatatgctgaccaactctctcgttgaagagtcaattgcaacatatcaaaggacattaaataggatcaattacctgagtggggtggctgggcagattaacggtgctatcaaaagaaaggcaatcgacggcgaaaaaatacacctgcctgccgcctggagtgagctcatctccttacctttcattggacagccggtgattgatgtggagagcgacctggcacacttaaaaaaccagtaccagaccctgtccaatgaatttgacaccctcatttcggccctgcagaagaacttcgatttgaatttcaacaaagcactccttaaccgcacgcagcatttcgaggcaatgtgccggagcacaaaaaaaaatgctttatctaagcccgagatcgtgtcctacagagatctgctggcgcggctgaccagttgcctttatcgaggctcgctggttctcagaagggcgggaatcgaagttctgaaaaagcacaaaatctttgagtcgaatagtgagctgagagaacacgtccacgagcgaaagcacttcgtgttcgttagtccattggacagaaaggcaaaaaaactgttgcgcctgaccgattcccgccctgacttgctccatgtgatcgatgagatcctgcaacatgacaatctggagaataaggacagagagtccctttggctggtccggtctgggtacctccttgctggtctgccggaccagctgagttcttcgtttatcaatctccccataatcacgcaaaagggcgatcgccggctgattgacctgattcagtatgaccagatcaatcgcgatgctttcgtaatgttggtgacaagtgctttcaaaagcaatctctctgggttgcagtaccgcgctaacaagcagtctttcgtggtcacccgcaccctgtctccttacctgggtagtaagctcgtatacgtccctaaagacaaagattggctggtcccatcccagatgtttgagggaagattcgccgatattctgcagagtgactacatggtctggaaggatgccggacgcctgtgcgtgatcgacactgccaaacatctctctaacattaaaaaaagcgtgtttagtagcgaagaagtccttgcttttcttcgagagctgcctcaccggaccttcatccagaccgaggtacgggggttaggagtgaacgtcgatggaatcgcatttaataacggggatatcccgagcttgaagacattctcgaattgtgtgcaggtgaaggtgagtaggactaatactagtctcgtgcagactctaaacaggtggttcgagggtggcaaagtgtcacctccctctattcagttcgaaagagcttactacaaaaaagacgatcagattcacgaggacgcagccaagagaaagatacgcttccagatgccagcaacggaattagtgcacgccagcgatgacgctggttggacccccagctacctgctgggcatcgaccccggtgagtacggaatgggtctcagtttggtgtccatcaacaatggagaggtcctggattctggattcatccacattaattccctgatcaatttcgcgtccaaaaaaagcaatcaccagaccaaagtagtcccccgccagcagtacaagtccccctacgcgaattatctcgagcagtcaaaggattcagcagcaggggatatagctcacattctggatcggctaatctacaaattgaacgccttgcctgtgttcgaggcgctgtctggcaacagtcagagtgctgctgatcaggtatggaccaaagttctatccttctatacatggggagacaacgacgcacagaacagtatacggaagcagcactggttcggtgcctcacactgggatattaaggggatgctgcgccaacccccaaccgaaaaaaaacccaaaccatatatagcctttcccgggagtcaagtgtcatcctatggaaatagtcaaaggtgtagttgttgcggccgcaatcccattgagcagttgcgtgagatggcaaaggacacgagtatcaaggagctgaaaatccgaaatagtgagatccaactattcgatggtacaatcaagctgtttaaccccgacccttccaccgtcatcgagaggcggcggcataacctaggaccctcacgcattcctgtggcagaccgaactttcaagaatattagcccttcttcgttagagttcaaggagctcattactatcgtttctcgaagcatccgccatagccccgaatttattgctaagaaacggggtatcgggtctgagtacttttgtgcttattctgactgcaactcctcactgaactcagaggccaatgccgcggccaatgtggcacagaagtttcagaagcaactctttttcgaactctga

SEQ ID NO: 163 - DNA, 3864 bp, Artificial Sequence
  Description of Artificial Sequence: Synthetic polynucleotide
atgaaacgtattctgaactctctgaaagtcgccgcactgaggctgctgtttcgaggaaagggctcagagctggtgaagaccgtcaagtaccctctggtttcgcccgtccagggtgctgtggaagaactcgccgaagcaatacgccacgacaacctacatttatttgggcagaaggaaatcgtagatctgatggagaaggacgagggcacccaggtctactcggtggtggacttttggctcgacacactccgtctagggatgttcttcagtccaagtgctaatgcccttaagatcactctggggaagtttaacagcgaccaagtttcccctttcaggaaggttctggagcagtcccctttctttctcgcgggtagactcaaagtggagcccgctgaacgtatcctcagcgtggagatccgcaagatcggtaagagggagaatagagtggagaactacgccgcagatgtagagacttgttttatcggtcagctgtctagtgatgaaaagcagtctatccagaagctcgctaacgatatctgggactctaaggatcacgaagagcaaaggatgcttaaggcggatttctttgccattcccctcatcaaagacccaaaggcagtgaccgaggaagatcccgagaatgaaaccgcaggcaaacagaagcctctcgaattatgtgtgtgcttagtgcccgagttgtacacccgcgggttcggttcaatagcggacttcctggtccagcgtctgacactattaagagacaaaatgagcacagacacagcagaagactgccttgagtatgtcggcatagaggaggagaagggtaatgggatgaactcgctgctggggacgttcctcaagaacctgcagggagacgggttcgaacagatcttccaatttatgctcggcagttacgtgggatggcaaggtaaggaagacgtcctacgcgaacggcttgatttgctagcggagaaggttaaaagactgccgaaacctaagtttgccggcgagtggtccggccatcggatgttcctgcatggtcaattgaagagctggtcctctaactttttccgcctgtttaacgagactagggagctcctcgaaagcataaaatccgacatccaacacgcgaccatgttaatcagctacgtcgaagagaaagggggataccacccacaactcttgtcacagtacaggaaactaatggagcagctgccagctctcagaacaaaggtgttagatccagagatagaaatgactcacatgagcgaggcggtaaggtcgtacattatgatccacaagtcggtagcaggatttctgcctgacttactcgagtccctcgatagggacaaggacagggaattcctgctgagtatatttccaaggatccccaaaattgacaaaaaaactaaggaaatcgtggcctgggagctcccaggcgagcccgaagaaggatacctgttcactgccaataatctttttcgcaactttctggagaatcctaaacatgttccacgtttcatggcagaaaggatcccggaagattggacgcgcctgcggtccgctcccgtatggtttgacggcatggtgaaacaatggcagaaagtggtaaaccagctggtggagtcacctggagcattgtatcagttcaatgaaagctttctccgacaacgtttacaggcaatgctgacagtgtataagagagacctgcagacagagaaattccttaagttgttggctgatgtctgcaggcctctggtggacttctttgggctggggggaaacgatatcatcttcaaaagctgccaggacccgaggaaacaatggcaaactgtcattcccttgagtgtccccgctgatgtgtacaccgcgtgtgaggggctggcaatccggcttcgtgagacattgggatttgagtggaagaaccttaagggccatgaaagggaggactttctaagactgcaccagcttttagggaatctgcttttctggattcgagatgccaaactggtggtgaaattggaagattggatgaataatccctgtgttcaggagtacgttgaggctcgtaaggccattgatctcccactggagatcttcggctttgaggtccccatcttcctgaacggatatctgtttagtgaactgaggcagttagaactgctgctccgccgtaagtcggttatgaccagctattcggttaagacaactggcagtccaaacaggcttttccagttagtctacctgccattaaatccttccgaccctgagaaaaaaaattctaataactttcaggaacgcctggacacccccactggcttatcacgtcgcttcctggaccttactctggacgccttcgccggcaagttgctgacagaccccgtgactcaagagcttaaaactatggctgggttctacgatcacctgtttggtttcaagctcccatgtaagctggcagccatgtctaaccaccctggctctagcagcaagatggtcgtgttggccaaacctaaaaaaggggttgcatctaatataggattcgaaccaatccctgatcccgcgcaccccgtattccgggtgagatcatcatggccagagctgaagtatctggaggggttactgtatcttccagaagacactccactgacaatagagctcgcagagacaagtgttagttgtcagagcgtcagtagcgtggcattcgatctgaaaaatctgactactatccttggacgcgtgggtgagttccgtgtgaccgcagaccagccttttaagttgacccccatcatccctgagaaggaggagtccttcataggaaaaacatatctaggccttgatgccggggaacgctcaggcgtagggttcgctatcgtcacagtcgacggggatgggtacgaggtacagcgcctgggggtgcatgaagatacacagctgatggccctacagcaggtggcctctaaaagcttgaaggagccggtgttccagccgctcagaaagggtacttttcggcagcaggaacgtattagaaaatctctcagaggatgttattggaacttctatcacgctctgatgattaagtaccgcgccaaggtagtgcacgaagagagcgtgggcagttccggcctggttgggcagtggttacgagcattccagaaggacctcaagaaagccgatgtgttgccaaaaaagggaggcaaaaacggagtcgataagaaaaagagagagtcttctgcacaagacacattgtggggaggggcttttagcaagaaggaagaacagcagatagctttcgaagtccaagctgctggttctagccagttctgcctgaagtgcggatggtggttccaactcggaatgcgtgaggttaatcgcgtgcaggaatccggcgtcgtgctggattggaatcggagtattgtcacattcctgattgagagctctggcgagaaagtgtatgggttctcccctcagcaactcgaaaaggggttcagaccagacattgaaaccttcaagaagatggttcgggatttcatgcgcccgcctatgtttgaccggaagggtcgcccagcagctgcctacgaaaggtttgtcttgggacgccggcatcggcggtatagattcgacaaggtttttgaagaacgattcggacgatccgcgctattcatttgcccgagggttggctgtggcaactttgaccacagcagcgagcagtcagccgtagtgctggctctaatcggatatattgccgacaaagaggggatgagcggaaaaaagctagtctacgtgcgtctggcagaactaatggcggaatggaaattgaagaaactggagaggagtagagttgaggagcaaagctccgctcagtga

SEQ ID NO: 164 - DNA, 3579 bp, Artificial Sequence
  Description of Artificial Sequence: Synthetic polynucleotide
atggcggagtcgaagcaaatgcagtgcaggaagtgtggagcctctatgaagtacgaagtgatcggcctcgggaagaaaagctgcagatatatgtgtcccgactgcgggaatcacacatctgcaagaaagattcagaataagaagaaaagggacaagaagtatggatctgccagtaaagcacaaagccaacgaatcgcagttgcaggggccttatacccggataaaaaggttcagaccatcaagacttataagtatccagccgacctgaatggtgaggtccatgactcaggggtggccgaaaaaatagcccaagcaatccaggaggatgaaatagggctcctcggcccctcttccgagtacgcctgttggatcgctagccagaaacagagcgagccctacagtgttgtagacttttggtttgacgctgtgtgcgccggaggcgtgttcgcctattctggggctagattgctgtctaccgtcctgcagctatctggggaggagagcgtcctacgcgcagccctggcatcctccccttttgtcgacgatatcaatctggcacaggccgaaaaatttctggcggtgtccaggcgaaccggccaagataagctggggaagcgcattggagagtgcttcgcagagggccgacttgaggccctaggcatcaaggaccggatgcgtgaatttgtccaggctatcgatgtcgctcagaccgctgggcagcgttttgccgcgaaactgaaaatctttgggatttctcagatgcccgaggcaaagcagtggaacaatgacagcggactcaccgtgtgcatcctgcccgactattacgtcccagaagaaaatcgcgcagatcagttggtcgtcctgctaagacgactgagagagatagcatactgtatggggatcgaagatgaggccggttttgaacatcttggaattgatcctggcgcactatcaaatttttccaatggcaatcctaaacgcggatttttgggccgcctgctgaacaatgatattattgccttagcgaacaacatgtccgccatgacgccttactgggagggcaggaagggagaactgattgaaagattggcttggctgaagcaccgtgcagaggggctttatctgaaggaaccgcattttggaaatagttgggccgaccataggtctagaattttttccagaatagccgggtggctttctgggtgcgctgggaagctaaagatcgccaaagaccagatcagcggagtgcgtactgatctgttccttctgaagagactgctggatgcggtcccgcagtccgccccttctcccgacttcatagcctctatctctgccttggatcgcttcctggaggccgcagaatctagtcaggatcctgccgaacaggtgagggccctatacgcctttcatctgaacgcacccgcggtgcgaagcatcgccaacaaggcagtccagcgatccgacagccaagaatggcttataaaggaactggacgctgtggaccacctggagtttaacaaggcctttcccttcttctctgatacgggaaagaagaaaaagaaaggggctaactcgaatggcgctccgtccgaggaggagtacaccgagactgagagcatccagcagcccgaggacgctgagcaagaggttaatggtcaggaaggcaacggggcctcgaagaaccagaagaagtttcagagaatcccccgattcttcggcgaggggagtcgcagcgagtatcgcatcctcactgaagccccgcagtacttcgacatgttctgtaacaacatgcgggccatctttatgcaattagaatcccaaccgcgtaaagctcccagggattttaagtgtttcctgcagaatcggctgcagaaattgtataagcagacattcctgaacgctcgatccaacaagtgccgggcattactagagtccgtattgattagttggggagagttttacacctacggggctaacgagaaaaaatttcgactgcgtcatgaagcttctgagcgctcctcggacccagattacgtggtgcaacaggcgctggagatcgctcggaggctgtttctcttcggctttgagtggagggactgtagcgcaggtgaaagagtggatctggtcgaaatacataagaaagccatatctttcctgttggccatcactcaggctgaggtgtctgtgggcagctataactggctgggcaattctaccgtgagtcggtacctgtccgtggcagggactgataccctttacggcacccagctggaagaattcttaaatgcaaccgtgttatctcagatgcgggggctggctatcaggttatcatctcaggaactgaaggatggatttgacgtacagctggagtctagttgccaggataatctgcaacacttgctcgtgtacagggcttcacgagaccttgccgcctgcaagcgcgctacttgtccagctgagttggatcctaagattctggtactgcccgtgggggcctttatcgctagcgtgatgaaaatgattgaaagaggggatgagcctttagctggagcttatctgagacacagaccccatagtttcgggtggcagatccgcgttcgaggtgtggcagaggtgggaatggaccaagggaccgccctggcgttccagaaaccgaccgagagcgaacccttcaagataaagccgttttccgctcaatacggccccgttctatggctgaacagctccagttatagccagagccagtacctggacgggttcctatcacagcccaagaactggagtatgcgggtgctgccacaggccggctcagtgcgggtagaacagcgcgtcgccttgatttggaatctccaggccggaaagatgaggctggaacggagcggagcgcgggctttcttcatgcccgtcccattcagtttccgccccagtggcagcggcgacgaggcagtcctggctccaaataggtacctgggactctttccacacagcggcggcatagagtacgctgtggtcgatgttcttgactctgccggcttcaaaatactcgagagaggaacaatagccgtcaatggcttctcccagaaacgaggagaaagacaagaggaagcccatcgcgaaaaacaaagacgcggtatctccgatattgggcgcaagaagccagtccaggccgaagtcgatgcggccaacgagctccatcgaaaatacaccgatgttgctactcggctggggtgtcgaattgtcgttcaatgggcaccccaacccaaaccaggcactgcgccgaccgctcagactgtgtacgctagggccgtgaggactgaagcaccaagatccggcaatcaggaagatcacgccaggatgaaatcttcctggggatacacatggggtacgtattgggaaaaaaggaagcccgaggacatcctcggcattagtacccaggtgtattggacaggcgggatcggcgagtcctgcccggctgtcgccgtcgcgctattgggacacatcagggccacctcaacccagactgaatgggagaaagaggaagtcgtgtttgggcgattgaaaaagttcttcccatcctga

SEQ ID NO: 165 - DNA, 2958 bp, Artificial Sequence
  Description of Artificial Sequence: Synthetic polynucleotide
atggagaagcgcatcaataaaattcgcaagaagctgtctgccgataacgccacaaaaccagttagtcgaagcggcccaatgaagaccctgctagttcgagtgatgactgatgatctgaagaaaaggctcgaaaagcgacgcaagaagcctgaggtaatgcctcaggttataagtaacaatgcagcaaacaatctgcggatgctgcttgacgattacacaaagatgaaggaagccattctccaggtgtattggcaggagttcaaggatgatcacgtaggcctgatgtgtaaattcgcgcaacctgcaagcaagaagatcgaccaaaacaagctgaaacccgagatggatgaaaaaggcaatttaacaaccgccggattcgcttgttcccagtgtgggcagccactgttcgtgtacaagttagaacaggtgtcggaaaaaggaaaggcatacactaactactttggacggtgcaatgttgcagaacacgaaaagctgatactgcttgcccagcttaagcccgaaaaagacagcgacgaagcggtgacctacagcctgggaaaattcgggcagcgggcactggacttctattctatccacgttaccaaggagagcacccacccagtgaagccgttggcccaaatcgctggaaaccggtacgccagcggaccagtcggcaaggccctgtccgatgcctgtatgggcacaattgcttctttcctgtccaagtaccaggacatcataatcgagcaccaaaaagttgtgaaagggaatcagaaacgcctggaatcccttcgagaactggccggcaaggagaaccttgagtacccgtccgtgaccctgcctccacagccacataccaaagagggcgtagacgcgtataatgaggtcattgcccgcgttcgcatgtgggttaatttaaacctgtggcagaaattaaaactaagccgagatgatgctaaaccgttactgagattgaagggattccctagctttcctgtggtggagagaagggaaaacgaggttgattggtggaatactattaatgaggtgaaaaagcttattgacgccaagagggatatgggcagggtgttctggagcggggtgactgccgaaaagagaaataccatcctcgagggatacaattacctccccaacgagaatgatcataagaaaagagaggggagcttagagaatccaaagaaacctgcaaagaggcaattcggtgatctcctgctctacctcgagaagaaatacgcgggggactggggaaaagtttttgacgaagcctgggagcgcattgacaagaagatcgccgggctgacgtctcacattgaacgggaagaggcacggaatgcagaggacgcccagtctaaggccgtgctgactgactggctgcgcgcaaaggcctccttcgtgctcgaacgtctgaaggaaatggatgagaaagagttttacgcgtgtgaaatacagctgcagaagtggtacggcgatctaaggggaaatcccttcgcagtggaagccgagaatagggtagttgacatcagtgggttctccatcggcagtgatggacattctatccagtatagaaacctgctcgcctggaagtacttagagaacggcaagagagagttctatctgctgatgaactacgggaaaaaaggtagaattcgctttacagatggcaccgacataaagaagtccggaaagtggcaaggcctcttatacggaggcggcaaagcaaaggtgatagacttgacttttgaccctgacgacgaacagctgataatcttgccgctggcctttggcacaagacaaggtagggaatttatctggaatgatcttctttctctcgagaccggactcatcaagctcgcaaacggaagggtcatcgagaagacaatctacaataaaaagataggccgagacgagccagccctgtttgtggctttgacatttgagcggagagaggtcgtagatcccagcaacatcaaacccgtgaacctgatcggtgttgacaggggcgagaacatcccggcggttatcgcactgacggatccagaaggatgtcctctgcccgagttcaaagattcatcgggagggccaaccgacattttgaggataggggaggggtacaaggagaagcagcgagctatccaggcggccaaagaagtggagcaacgaagagctggtggttattctcgcaagttcgcttccaaaagtcgtaacctggctgacgatatggtgcgcaattctgcccgtgaccttttctaccacgccgttacacacgacgccgtgttagtgtttgaaaatcttagtcgaggcttcgggcgacaggggaagcggacctttatgaccgagagacagtatacaaaaatggaggattggctgaccgccaaactggcgtatgaaggactcacatccaagacctatctctcaaaaactttggcccagtatacatctaagacgtgcagtaactgtggcttcaccattaccacagctgactacgatggcatgctggtccgcttaaaaaagacatctgacggctgggctactaccctcaacaataaagagctcaaagccgaaggacaaattacctattataacaggtataaaagacagactgtcgagaaggagttgagcgcggagctggaccgcctatcagaggagtcagggaacaacgatatctctaagtggactaagggacgccgagacgaggcgttgttcttgctgaaaaagcggttctctcatcgacccgtgcaggagcagttcgtgtgtctggactgcggccacgaggttcatgctgatgagcaagctgctctaaatattgcccgtagttggttgttcctgaacagcaattcaacagagttcaagtcatacaagagcggaaagcagccgtttgtgggcgcatggcaggcattttacaaaagacgcctgaaggaagtgtggaagccaaacgcc

SEQ ID NO: 166 - DNA, 2919 bp, Artificial Sequence
  Description of Artificial Sequence: Synthetic polynucleotide
atgaaaaggattaacaaaatccgaaggcggcttgtaaaggattctaacaccaaaaaggctggcaagacggggcccatgaaaacattactcgttagagttatgacccccgacctcagagagcgactggaaaatttacgcaagaagccagagaacatacctcagccaattagtaatacctctcgggcaaacctaaacaagttgcttactgattacacggagatgaaaaaggccatactgcatgtgtactgggaggagtttcaaaaggaccctgtcgggctaatgagcagggtggctcagcctgcacctaaaaacatcgaccagcggaaactcatcccagttaaggacggaaatgagagattgacaagttcaggtttcgcctgctcacagtgctgtcaaccgctgtacgtttataagttagaacaagtgaatgacaaaggaaagcctcacacaaattattttggccggtgtaatgtctctgagcatgagcgtctgattctgttgtccccgcataaaccggaagctaatgacgagctcgtaacctacagcttggggaagtttggccaaagagcattggacttctattcaatccatgtgacccgcgaatccaatcatcccgtcaagcccttggagcagatagggggcaatagttgcgcttctggccctgtgggcaaagccctgtccgacgcctgtatgggagccgtggcttcattcctgaccaaatatcaggatatcatcttggagcaccagaaagtgatcaagaaaaatgaaaaaaggttagcaaacctcaaggatattgcaagcgctaacggcttggcttttcctaaaatcacacttccacctcagcctcacacaaaggaaggcatcgaggcatacaacaatgtggtggcccagatcgtcatctgggttaacttaaacctgtggcagaaacttaaaattggcagggatgaggcaaaacccttacagcgcctgaaaggattccccagctttccactggtggagcgccaggctaacgaagtggactggtgggatatggtgtgtaacgtcaagaagctcatcaatgaaaagaaagaggacggtaaagtcttctggcagaacctcgccggttacaaacggcaggaggcgctgttaccttatctgtcgagtgaagaggaccggaaaaaaggcaagaaatttgctcgttatcagtttggtgatttgctcctacatttggagaagaagcacggcgaggactggggaaaagtatacgatgaggcctgggagaggattgacaaaaaggtggagggactgtcaaagcacatcaagctcgaagaagagcgcagaagcgaggacgcccaatccaaagcagcgctgactgactggctgcgggcgaaggccagttttgtaatcgaaggccttaaagaagccgacaaggatgaattctgcagatgcgaattaaaactccagaagtggtacggcgatctccgaggtaagcctttcgcaatcgaggccgagaattccatactggacattagtggattcagtaaacagtataattgtgcctttatatggcagaaggatggtgtcaagaaactcaacctgtaccttattattaattatttcaaaggcgggaaactgagatttaagaagataaagcctgaagcctttgaggcgaaccgattctacacagttattaacaagaaatctggtgaaattgtacccatggaggtaaacttcaacttcgatgatcccaatctgattatattgccactagcttttggcaagcggcagggtagggaattcatttggaacgatttgctttcactggaaacagggtcccttaagctggcaaacgggagagtgattgaaaagacattgtacaatcggaggacacgtcaggatgaacctgcccttttcgtggctctgacattcgagcgcagggaggttctggactctagcaatatcaagccaatgaacctgatcggcatagaccgaggagagaatattccggctgtgatcgcactcaccgatcccgaaggatgtcccctttctcggttcaaggactccttaggcaatccaactcatatcctgagaatcggcgagtcatacaaggagaagcagcgaacaattcaggccgccaaggaagtcgagcagaggcgagctggcggctacagccgtaaatacgctagtaaagctaagaacctggccgacgatatggtgcgcaatactgctagagacctgctgtactatgcagtgacgcaggacgcaatgctgatattcgagaatctgtccagaggattcggaaggcagggcaagcggacgttcatggccgagcgccagtatacaaggatggaggattggttaacggccaagcttgcctatgaggggctacctagtaagacctatctgtctaagacgctggctcaatacaccagtaagacctgctcaaactgtggctttacaatcacttctgctgattatgatagagtgctcgagaagctaaaaaaaactgccaccggctggatgactactattaatgggaaggaactgaaagtggaaggacagattacctattataatcgctacaagcgtcaaaacgtcgtcaaggacctgtcggtggaattggacagactcagtgaagagtccgtgaacaatgatatcagctcctggacaaaagggcgcagtggggaggcactcagcttgcttaaaaagaggttttcacatcggccggtccaggagaaatttgtctgcctgaactgcggattcgagacacacgccgacgagcaggcagcactgaacattgccagatcctggctgttccttaggtcccaggaatataagaagtaccagactaacaaaaccacgggaaacacagataaaagggcctttgtcgaaacttggcaatccttttaccggaagaagttaaaggaagtgtggaagccc

SEQ ID NO: 167 - DNA, 4107 bp, Artificial Sequence
  Description of Artificial Sequence: Synthetic polynucleotide
atggataagaaatactcaataggcttagcaatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 168 - DNA, 4107 bp, Artificial Sequence
  Description of Artificial Sequence: Synthetic polynucleotide
atggataagaagtattcaattggacttgcgattggcactaacagtgtgggctgggcggtgattacagacgagtataaggtgccgtcaaaaaagtttaaagttctgggcaacactgatcgccattccatcaagaaaaacctaatcggggcccttctttttgatagtggcgaaacggccgaggcgacgcgtctaaaacgtaccgcgcggcgtcgctacacccgacgaaaaaaccgtatttgttaccttcaggagatcttcagtaacgaaatggctaaggtggacgattcattcttccaccgtctggaggagtcctttttagttgaagaagacaagaagcatgagcgacacccaatttttggtaacattgtcgacgaagtcgcctatcacgaaaaatatccgaccatttatcacctgcgcaaaaaactggtcgatagcacggataaagcggatctgcggcttatttacctggcgcttgcccacatgatcaagttccgcggccacttcctgatagaaggagacctgaacccggataatagcgatgtagacaaactgtttattcagctggtccagacctacaaccagctgtttgaagaaaatccgattaatgcgtcaggcgtggatgcgaaagcgatactgagtgcccgcctgtcgaaatctcgccgtctcgaaaatctgattgcacagctgcccggcgaaaaaaaaaacggtctttttggcaatctgatcgcgctgtcactgggcctgacaccaaattttaagagcaacttcgacctggcagaggatgcgaagcttcaactgtcgaaggacacctatgacgatgatctggataatcttctggcacaaatcggtgatcagtatgcggatttattccttgcagcgaaaaacctatctgacgcaattctgttgagcgatatcctccgcgtcaacaccgaaatcactaaagcccccctgtcagcgtcgatgattaaacgttatgatgagcaccatcaggatctgaccttgctaaaggcgctggtgcgacagcagcttcccgaaaaatataaagagatcttttttgatcaatcgaagaatggttatgccggatacattgatggcggagccagtcaggaagaattttacaaattcatcaaaccgatcctggaaaaaatggatggcacagaagaactgcttgtgaaattgaaccgggaagatttactgcgcaaacagcgtacgttcgacaacggctccataccccatcagattcacttaggtgagctgcatgcaatactccgtcgccaggaagatttttatccatttttaaaagacaaccgtgagaagattgaaaaaattttaacttttcgtattccatattacgtcgggcctttggcccgaggtaactctcgattcgcctggatgacgagaaaaagcgaggagaccatcactccgtggaattttgaagaggttgttgataaaggcgcgagcgcccagtcgtttatcgaacgtatgaccaactttgataaaaatctgccgaatgaaaaagtgcttccgaagcattctctgttgtatgaatatttcactgtgtacaatgagttaacgaaagtgaaatatgtgaccgaaggcatgcggaaacctgcttttctgtccggagaacagaaaaaagcaattgtggacctgctgttcaaaacgaaccggaaagtaactgtgaagcagctgaaagaggactacttcaaaaaaatcgaatgcttcgactcagtagagatctctggtgttgaagatcgcttcaacgcgagtctgggaacgtaccatgatttgttgaaaatcatcaaagataaagactttctggataacgaagagaatgaggacattcttgaagatattgttttgacactgactctgtttgaggatcgcgaaatgattgaagagcgcctgaaaacgtatgcccatttattcgatgacaaagtcatgaagcagctgaaacgtcgccgctatactgggtggggcagactttcacgtaaattgatcaatggtataagagacaaacagagcggcaaaactatcttagatttcctgaagagtgatggatttgccaaccggaattttatgcagcttatacatgatgactcgctaacgtttaaagaagacattcagaaggcgcaggtcagcggccagggtgattcgctgcatgaacacattgcaaatcttgccggatcgccagcgatcaaaaaaggcatccttcagacagtaaaagttgtggatgaactggtgaaagtaatgggtcgtcacaagccagaaaatattgtgatcgaaatggcccgggaaaatcagactactcaaaaaggtcagaaaaattctcgcgagcgtatgaaacgtattgaagaaggcatcaaagagctaggcagccagatattaaaggaacatccggttgagaacactcagctgcagaatgaaaaactgtatctgtattatcttcagaacggccgtgacatgtatgttgatcaagaactggatatcaatcgcttgtccgattatgacgtggatcatattgttccgcaaagctttctgaaagacgattctattgacaataaagtactgacacgttcggacaaaaaccgtggtaaaagcgataacgtaccgtcggaagaagttgttaagaaaatgaaaaattattggcgccaactcctgaatgctaaattgattacccagcggaaatttgataacttaaccaaagccgagcggggtggcttaagtgaactggataaagcgggttttattaaacgccaactggtagaaacccgccagataacgaaacatgtagctcaaatcctcgatagtcgcatgaatacgaaatatgacgaaaatgataaattgatccgtgaagtaaaagtgattactcttaaaagcaaattggtatctgattttcggaaagatttccaattctataaggtgagagaaattaacaattaccatcatgcacatgatgcgtatttaaatgcagttgttggcaccgccttaatcaaaaaatatccgaaattagaatctgagttcgtgtatggtgattataaagtttatgatgttcgaaaaatgattgctaagtctgaacaggaaatcggcaaagcgaccgcaaagtattttttttatagcaatattatgaatttttttaaaactgagattaccctggcgaatggcgaaattcgcaaacgtcctctgattgaaaccaatggcgaaaccggcgagatagtatgggacaagggccgtgattttgcgaccgtccggaaagtcctgtcaatgccgcaggtgaatattgtcaagaaaacagaagttcagacaggcggttttagtaaagagtctattctgcccaaacgtaattcggataaattgattgcccgcaagaaagattgggatccgaagaaatatggtggattcgattctccgacggtcgcctatagcgttctagtcgtcgccaaggtcgaaaaaggtaaatccaaaaaactgaaatctgtgaaagaactgttaggcattacaatcatggaacgtagtagttttgaaaagaacccgatcgacttcctcgaggcgaaaggctacaaagaagtcaagaaggatttgattattaaactcccaaaatattcattatttgagttagaaaacggtaggaagcgtatgctggcgagtgctggggaattacagaaagggaatgagttagcactgccgtcaaaatatgtgaactttctgtatctggcctcccattacgagaaactgaaaggtagcccggaagataatgaacagaaacaactatttgtcgagcaacacaaacattatctggatgaaattattgaacagattagtgaattctctaaacgtgttattttagcggatgccaaccttgacaaggtgctgagcgcatataataaacaccgtgataaacccattcgtgaacaggctgaaaatatcatacatctgttcacgttaaccaacttgggagctcctgccgcttttaaatatttcgataccacaattgaccgcaaacgttatacgtctacaaaagaggtgctcgatgcgaccctgatccaccagtctattacaggcctgtatgaaactcgtatcgacctgtcacaactgggcggcgactga

SEQ ID NO: 169 - DNA, 4107 bp, Artificial Sequence
  Description of Artificial Sequence: Synthetic polynucleotide
atggacaagaaatattcaatcggtttagcaataggaactaactcagtaggttgggctgtaattacagacgaatacaaggtaccgtccaaaaagtttaaggtgttggggaacacagatagacactctataaaaaaaaatttaataggcgctttacttttcgattcaggcgaaactgcagaagcgacacgtctgaagagaaccgctagacgtagatacacgaggagaaagaacagaatatgttacctacaagaaattttttctaatgagatggctaaggtggatgattcgttttttcatagactcgaagaatctttcttagttgaagaagataaaaaacacgaaaggcatcctatctttggaaacatagttgatgaggtggcttaccatgaaaaatatcccactatatatcaccttagaaaaaagttggttgattcaaccgacaaagcggatctaaggttaatttacctcgcgttggctcacatgataaaatttagaggacatttcttgatcgaaggtgatttaaatcccgataactctgatgtagataaactgttcatccagttggttcaaacatataatcagttgttcgaagagaaccccattaacgcatcaggtgttgatgctaaagcaatcttatcagcaaggttgagcaagagcagacgtctggaaaacttgattgcccaattgccaggtgaaaagaagaacggtctttttggaaatttaattgcactttcacttgggttgacaccgaattttaaaagcaatttcgacctcgctgaggatgctaaactccagttatctaaggatacatatgacgatgatttggataatctattggcccagataggtgatcagtatgcagatttgtttttggcagctaagaatttatcagatgcaattctactgagcgatattttaagggtgaatacagaaataactaaagcacctttgtctgcatctatgataaaaagatacgatgaacaccatcaagatctcacactattaaaagctttagttagacaacaattaccagaaaaatataaagaaatctttttcgatcagtccaagaacggatacgccggctatatagatggcggtgcctcccaagaagaattttacaaatttatcaaacccattttggaaaagatggatggtactgaagaattattggtcaaattaaacagggaagatttattaagaaaacaaaggacctttgataatggttctattccacaccaaatccatctaggggaattacatgcgattcttagaagacaagaagatttttatccattcttgaaagataacagggaaaagatagagaaaatcttaacttttagaattccctactacgtcgggcccttagctagggggaattctagattcgcctggatgacacgcaaatcagaagaaacaattacgccttggaattttgaagaagttgttgataaaggagcctctgctcaatcttttattgaacgaatgaccaattttgataagaatttacccaatgaaaaggtcttacccaaacattcactcctatacgagtactttactgtttacaatgagttgacaaaagtgaagtatgttaccgagggtatgcgaaaacctgctttcttgagtggtgaacaaaagaaggccattgttgacttgttattcaaaactaacagaaaggtcactgtgaagcagcttaaagaagattatttcaaaaagatcgaatgtttcgactcggtagaaattagtggtgtggaagatagatttaatgcttctcttggaacatatcatgatctactaaagatcatcaaagataaagatttcttggacaatgaagaaaatgaagatattcttgaagacatcgtgttgacacttacattgtttgaggacagagaaatgattgaagaaaggctgaagacctacgcccatttgtttgatgataaagtcatgaaacagttaaagaggagaaggtataccggatggggtaggctgtctcgcaaattgattaatggtattcgtgataaacaatcgggtaaaacaatcctagatttcctgaagtccgatggtttcgccaacaggaattttatgcaattgattcatgacgattctttgacttttaaagaggatattcagaaagcacaggtctcaggacagggcgattcactccatgaacatatagctaacctggctggctcccctgctattaagaaaggtatcttgcaaaccgtcaaagtagtagacgaacttgttaaagttatgggaagacacaaacctgaaaatatcgttattgaaatggctcgcgaaaaccagacaacacaaaagggtcaaaagaattcgagagagagaatgaagcgtatcgaagaaggtattaaagaacttgggtcccaaatacttaaagaacatccagtagaaaacactcagcttcaaaatgaaaaattatacttatattatcttcagaatggccgcgatatgtatgttgaccaagagttagatataaataggttgtctgattacgacgtggatcatattgtacctcaatcttttctaaaagatgattcaattgataataaggtattaacgagaagtgataaaaatagaggtaaatctgacaacgtgccaagcgaagaggtggtgaagaaaatgaaaaattattggcgtcaactgttgaacgccaagttaattacgcagagaaagtttgataatctaacaaaagctgaaagaggaggcctatctgagttagataaggccggttttatcaaacgtcagttagttgaaaccaggcaaatcacgaagcacgttgcccaaattctagattcaaggatgaataccaaatacgatgaaaacgataaactgattcgggaagtcaaggttataactctaaaaagcaaactagtttcagattttcgcaaagattttcaattttacaaagttcgagaaatcaataattatcatcatgctcacgacgcgtacttgaacgcggtcgttggtacagctttaataaagaaatatcctaaactggaatcggaatttgtatatggggattacaaagtatacgacgtgagaaagatgatcgctaaatctgaacaagaaattgggaaagcaactgccaaatattttttttacagcaacataatgaatttttttaaaacggaaattacattggcaaatggcgaaattagaaagcgcccattgatagagaccaatggagagactggggaaatcgtgtgggataaaggacgtgattttgccacagtgaggaaagtgttaagtatgccacaagttaatattgtaaaaaagaccgaggtccaaacgggtggatttagcaaagaatcaattttacctaagagaaattcagataaattaattgcccgcaaaaaggattgggatcctaaaaaatatggtggttttgattccccaacagttgcttactccgtcctagttgttgctaaggttgaaaaaggaaagtctaagaaacttaaatccgtaaaagagttactgggaattacaataatggaaagatcctctttcgaaaagaaccctattgacttcttggaggcgaaaggttataaagaagtcaaaaaagatttgatcataaaactaccaaagtattctctatttgaattggaaaacggcagaaaaaggatgttggcaagcgctggtgaactacaaaagggtaacgaattggcattgccgagtaaatacgtgaattttctatatttggcatcacattacgaaaagttaaagggatcacccgaggataacgagcagaaacaactgtttgttgaacaacacaaacattatcttgatgaaattatagaacaaattagtgagttcagtaagagagttattttagccgatgcaaatttagacaaagttttatctgcttataacaaacatagagataagcctataagggaacaagccgaaaatattattcatttgtttacgttaacaaatttaggggcaccagcagcattcaagtacttcgatacgactatcgatcgtaagcgttacacatctaccaaagaagttcttgatgcaactttgattcatcaatctataacaggcttatatgaaactagaatcgatctgtcacaacttggtggtgactaa

SEQ ID NO: 170 - DNA, 4107 bp, Artificial Sequence
  Description of Artificial Sequence: Synthetic polynucleotide
atggacaagaagtactcaattgggcttgctatcggcactaacagcgttggctgggcggtcatcacagacgaatataaggtcccatcaaagaaattcaaagtccttggcaatacggaccgacattcaatcaagaagaacctgattggagctctgctgtttgattccggtgaaaccgccgaggcaacacgattgaaacgtaccgctcgtaggaggtatacgcggcggaaaaataggatctgctatctgcaggaaatatttagcaacgaaatggccaaggtagacgacagcttcttccaccggctcgaggaatctttcctcgtggaagaagacaaaaagcacgagcgccaccccattttcggcaatatcgtggacgaggtagcttaccatgaaaagtatccaactatttaccacttacgtaagaagttagtggacagcaccgataaagccgaccttcgcctgatttacctagcacttgcacacatgattaagttccgaggccacttcttgatagagggagacctgaatcctgacaattccgatgtggataaattgttcatccagctggtacagacatacaatcagttgtttgaggaaaatccgattaatgccagtggcgtggacgccaaggctatcctgtctgctcggcttagtaagagtagacgcctggaaaatctaatcgcacagctgcccggcgaaaagaaaaatggactgttcggtaatttgatcgccctgagcctgggcctcacccctaactttaagtctaacttcgacctggccgaagatgctaagctccagctgtccaaagatacttacgatgacgatctcgataatctactggctcagatcggggaccagtacgctgacctgtttctagctgccaagaacctcagtgacgccattctcctgtccgatattctgagggttaacactgaaattacaaaggccccgctgagcgcgagcatgatcaaaaggtacgacgagcatcaccaggacctcacgctgctgaaggccttagtcagacagcaactgcccgaaaagtacaaagaaatctttttcgaccaatccaagaacgggtacgccggctacattgatggcggggcttcacaagaggagttttacaagtttatcaagcccatcctggagaaaatggacggcactgaagaactgcttgtgaaactcaatagggaagacttactgaggaaacagcgcacattcgataatggctccataccccaccaaatccatctgggagagttgcatgccatcttgcgaaggcaggaggacttctacccctttcttaaggacaacagggagaaaatcgagaaaattctgactttccgtatcccctactacgtgggcccacttgctcgcggaaactcacgattcgcatggatgaccagaaagtccgaggaaacaattacaccctggaattttgaggaggtagtagacaagggagccagcgctcaatctttcattgagaggatgacgaatttcgacaagaaccttccaaacgagaaagtgcttcctaagcacagcctgctgtatgagtatttcacggtgtacaacgaacttacgaaggtcaagtatgtgacagagggtatgcggaaacctgcttttctgtctggtgaacagaagaaagctatcgtcgatctcctgtttaaaaccaaccgaaaggtgacggtgaaacagttgaaggaggattacttcaagaagatcgagtgttttgattctgttgaaatttctggggtcgaggatagattcaacgccagcctgggcacctaccatgatttgctgaagattatcaaggataaggattttctggataatgaggagaatgaagacattttggaggatatagtgctgaccctcaccctgttcgaggaccgggagatgatcgaggagagactgaaaacatacgctcacctgtttgacgacaaggtcatgaagcagcttaagagacgccgttacacaggctggggaagattatcccgcaaattaatcaacgggatacgcgataaacaaagtggcaagaccatactcgacttcctaaagagcgatggattcgcaaatcgcaatttcatgcagttgatccacgacgatagcctgaccttcaaagaggacattcagaaagcgcaggtgagtggtcaaggggattccctgcacgaacacattgctaacttggctggatcaccagccattaagaaaggcatactgcagaccgttaaagtggtagatgagcttgtgaaagtcatgggaagacataagccagagaacatagtgatcgaaatggccagggaaaatcagaccacgcaaaaggggcagaagaactcaagagagcgtatgaagaggatcgaggagggcatcaaggagctgggtagccagatccttaaagagcacccagttgagaatacccagctgcagaatgagaaactttatctctattatctccagaacggaagggatatgtatgtcgaccaggaactggacatcaatcggctgagtgattatgacgtcgaccacattgtgcctcaaagctttctgaaggatgattccatcgacaataaagttctgacccggtctgataaaaatagaggcaaatccgacaacgtacctagcgaagaagtcgtcaaaaaaatgaagaactattggaggcagttgctgaatgccaagctgattacacaacgcaagtttgacaatctcaccaaggcagaaagggggggcctgtcagaactcgacaaagcaggtttcattaaaaggcagctagttgaaactaggcagattactaagcacgtggcccagatcctcgactcacggatgaatacaaagtatgatgagaatgataagctaatccgggaggtgaaggtgattactctgaaatctaagctggtgtcagatttcagaaaagacttccagttctacaaagtcagagagatcaacaattatcaccatgcccacgatgcatatcttaatgcagtagtggggacagctctgatcaaaaaatatcctaaactggagtctgaattcgtttatggtgactataaagtctatgacgtcagaaaaatgatcgcaaagagcgagcaggagatagggaaggccacagcaaagtacttcttttacagtaatatcatgaactttttcaaaactgagattacattggctaacggcgagatccgcaagcggccactgatagagactaacggagagacaggggagattgtttgggataagggccgtgacttcgccaccgttaggaaagtgctgtccatgccccaggtgaacattgtgaagaagacagaagtgcagacgggtgggttctcaaaagagtctattctgcctaagcggaatagtgacaaactgatcgcacgtaaaaaggactgggatccaaaaaagtacggcggattcgacagtcctaccgttgcatattccgtgcttgtggtcgctaaggtggagaagggaaaaagcaagaaactgaagtcagtcaaagaactactgggcataacgatcatggagcgctccagtttcgaaaaaaacccaatcgattttcttgaagccaagggatacaaggaggtaaagaaagaccttatcattaagctgcctaagtacagtctgttcgaactggagaatgggaggaagcgcatgctggcatcagctggagaactccaaaaagggaacgagttggccctcccctcaaagtatgtcaattttctctacctggcttctcactacgagaagttaaaggggtctccagaggataatgagcagaaacagctgtttgtggaacagcacaagcactatttggacgaaatcatcgaacaaatttccgagttcagtaagagggtgattctggccgacgcaaaccttgacaaagttctgtccgcatacaataagcacagagacaaaccaatccgcgagcaagccgagaatataattcaccttttcactctgactaatctgggggcccccgcagcatttaaatatttcgatacaacaatcgaccggaagcggtatacatctactaaggaagtcctcgatgcgacactgatccaccagtcaattacaggtttatatgaaacaagaatcgacctgtcccagctgggcggcgactag

SEQ ID NO: 171 - DNA, 4805 bp, Artificial Sequence; identical to SEQ ID NO: 69
  Description of Artificial Sequence: Synthetic polynucleotide

SEQ ID NO: 172 - DNA, 20 bp, Artificial Sequence
  Description of Artificial Sequence: Synthetic oligonucleotide
aattcaaaggataatcaaac

SEQ ID NO: 173 - DNA, 20 bp, Artificial Sequence
  Description of Artificial Sequence: Synthetic oligonucleotide
aatctctactctttgtagat

SEQ ID NO: 174 - DNA, 19 bp, Artificial Sequence
  Description of Artificial Sequence: Synthetic oligonucleotide
aatttctactgttgtagat

SEQ ID NO: 175 - DNA, 19 bp, Artificial Sequence
  Description of Artificial Sequence: Synthetic oligonucleotide
aatttctactagtgtagat

SEQ ID NO: 176 - DNA, 15 bp, Artificial Sequence
  Description of Artificial Sequence: Synthetic oligonucleotide
aatttctactattgt

SEQ ID NO: 177 - DNA, 18 bp, Artificial Sequence
  Description of Artificial Sequence: Synthetic oligonucleotide
aatttctactgttgtaga

SEQ ID NO: 178 - DNA, 16 bp, Artificial Sequence
  Description of Artificial Sequence: Synthetic oligonucleotide
aatttctactattgta

SEQ ID NO: 179 - DNA, 19 bp, Artificial Sequence
  Description of Artificial Sequence: Synthetic oligonucleotide
aatttctacttttgtagat

SEQ ID NO: 180 - DNA, 19 bp, Artificial Sequence
  Description of Artificial Sequence: Synthetic oligonucleotide
aatttctactgttgtagat

SEQ ID NO: 181 - DNA, 19 bp, Artificial Sequence
  Description of Artificial Sequence: Synthetic oligonucleotide
aatttctactcttgtagat

SEQ ID NO: 182 - protein, 6 aa, Artificial Sequence
  Description of Artificial Sequence: Synthetic 6xHis tag
HHHHHH

SEQ ID NO: 183 - DNA, 20 bp, Artificial Sequence
  Description of Artificial Sequence: Synthetic oligonucleotide
agcagctttatcatctgccg

SEQ ID NO: 184 - protein, 7 aa, Artificial Sequence
  Description of Artificial Sequence: Synthetic peptide
QQLYHLP

SEQ ID NO: 185 - DNA, 20 bp, Artificial Sequence
  Description of Artificial Sequence: Synthetic oligonucleotide
agcagttataataactgccg

SEQ ID NO: 186 - DNA, 70 bp, Artificial Sequence
  Description of Artificial Sequence: Synthetic oligonucleotide
accgtaaagttcgcgtgatggcagccgattatgaaaatcagctcgacgagttttccctcgatgcgcccat

SEQ ID NO: 187 - DNA, 70 bp, Artificial Sequence
  Description of Artificial Sequence: Synthetic oligonucleotide
accgtaaagttcgcgtgatggcagcctaataagagaatcagctcgacgagttttccctcgatgcgcccat

SEQ ID NO: 188 - DNA, 70 bp, Artificial Sequence
  Description of Artificial Sequence: Synthetic oligonucleotide
accgtaaagttcccgtgatggcagccgattatgaaaatcagctcgacgagttttccctcgatgcgcccat

SEQ ID NO: 189 - DNA, 62 bp, Artificial Sequence
  Description of Artificial Sequence: Synthetic oligonucleotide
accgtaaagttcgcagccgattatgaaaatcagctcgacgagttttccctcgatgcgcccat

SEQ ID NO: 190 - DNA, 38 bp, Artificial Sequence
  Description of Artificial Sequence: Synthetic oligonucleotide
ccgtctaamwacmhtttwkaatttctactrttgtagat

SEQ ID NO: 191 - protein, 11 aa, Artificial Sequence
  Description of Artificial Sequence: Synthetic peptide
  MOD_RES (3)..(3): Lys or Asn
  MOD_RES (4)..(4): Asn or Tyr
  MOD_RES (5)..(5): Asn, Thr, Ile, His, Pro or Leu
  MOD_RES (6)..(6): Leu or Phe
  MOD_RES (7)..(7): Glu or absent
  See specification as filed for detailed description of substitutions and preferred embodiments
PSXXXXXFLLL

SEQ ID NO: 192 - DNA, 36 bp, Artificial Sequence
  Description of Artificial Sequence: Synthetic oligonucleotide
gtttgattatcctttgaatttacatatctctcaaac

SEQ ID NO: 193 - DNA, 29 bp, Artificial Sequence
  Description of Artificial Sequence: Synthetic oligonucleotide
actacattttttaagacctaattttgagt

SEQ ID NO: 194 - DNA, 35 bp, Artificial Sequence; identical to SEQ ID NO: 86
  Description of Artificial Sequence: Synthetic oligonucleotide

SEQ ID NO: 195 - DNA, 36 bp, Artificial Sequence; identical to SEQ ID NO: 87
  Description of Artificial Sequence: Synthetic oligonucleotide

SEQ ID NO: 196 - DNA, 38 bp, Artificial Sequence; identical to SEQ ID NO: 88
  Description of Artificial Sequence: Synthetic oligonucleotide

SEQ ID NO: 197 - DNA, 32 bp, Artificial Sequence; identical to SEQ ID NO: 89
  Description of Artificial Sequence: Synthetic oligonucleotide

SEQ ID NO: 198 - DNA, 35 bp, Artificial Sequence; identical to SEQ ID NO: 90
  Description of Artificial Sequence: Synthetic oligonucleotide

SEQ ID NO: 199 - DNA, 33 bp, Artificial Sequence; identical to SEQ ID NO: 91
  Description of Artificial Sequence: Synthetic oligonucleotide

SEQ ID NO: 200 - DNA, 36 bp, Artificial Sequence; identical to SEQ ID NO: 93
  Description of Artificial Sequence: Synthetic oligonucleotide

SEQ ID NO: 201 - DNA, 36 bp, Artificial Sequence; identical to SEQ ID NO: 94
  Description of Artificial Sequence: Synthetic oligonucleotide

SEQ ID NO: 202 - DNA, 35 bp, Artificial Sequence; identical to SEQ ID NO: 95
  Description of Artificial Sequence: Synthetic oligonucleotide

SEQ ID NO: 203 - DNA, 52 bp, Artificial Sequence
  Description of Artificial Sequence: Synthetic oligonucleotide
  modified_base (19)..(33): a, c, t, g, unknown or other
actatcaatgggctaactnnnnnnnnnnnnnnntgaaacatctgcaactgcg

SEQ ID NO: 204 - DNA, 52 bp, Artificial Sequence
  Description of Artificial Sequence: Synthetic oligonucleotide
actatcaatgggctaactacgttcgtggcgtggtgaaacatctgcaactgcg

SEQ ID NO: 205 - protein, 5 aa, Artificial Sequence
  Description of Artificial Sequence: Synthetic peptide
KMFPK

What is claims is:

1. A nucleic acid-guided nuclease system comprising:
   (a) a nucleic acid-guided nuclease comprising the amino acid sequence of SEQ ID NO: 7, wherein the nucleic-acid guided nuclease is encoded by a wild-type or a codon-optimized nucleic acid;
   (b) an engineered guide nucleic acid capable of complexing with the nucleic acid-guided nuclease, wherein the engineered guide nucleic acid comprises any one of SEQ ID NO: 88, SEQ ID NO: 93, and SEQ ID NO: 94, and
   (c) an editing sequence having a change in sequence relative to the sequence of a target region in a genome of a cell and a mutation in a protospacer adjacent motif (PAM) site;
   wherein the system results in a genome edit in the target region in the genome of the cell facilitated by the nuclease, the engineered guide nucleic acid, and the editing sequence.

2. The system of claim 1, wherein the engineered guide nucleic acid and the editing sequence are provided as a single nucleic acid.

3. The system of claim 1, wherein the codon optimized nucleic acid is codon optimized for *E. coli*.

4. The system of claim 1, wherein the codon optimized nucleic acid is codon optimized for *S. cerevisiae*.

5. The system of claim 1, wherein the codon optimized nucleic acid is codon optimized for mammalian cells.

6. The system of claim 1, wherein the nucleic acid-guided nuclease has less than 40% protein identity to SEQ ID NO: 12 and SEQ ID NO: 108.

7. The system of claim 1, wherein the codon optimized nucleic acid is codon optimized for plant cells.

8. The system of claim 1, wherein the wild-type nucleic acid comprises the sequence of SEQ ID NO: 27.

9. The system of claim 1, wherein the codon-optimized nucleic acid has at least 95% identity to any one of SEQ ID NO: 47, SEQ ID NO: 133, or SEQ ID NO: 153.

10. A nucleic acid-guided nuclease system comprising:
    (a) a nucleic acid comprising SEQ ID NO: 27, SEQ ID NO: 47, SEQ ID NO: 133, or SEQ ID NO: 153, wherein the nucleic acid encodes for a nucleic acid-guided nuclease comprising the amino acid sequence of SEQ ID NO:7;
    (b) an engineered guide nucleic acid capable of complexing with the nucleic acid-guided nuclease, and
    (c) an editing sequence having a change in sequence relative to the sequence of a target region in a genome of a cell and a mutation in a protospacer adjacent motif (PAM) site;
    wherein the system results in a genome edit in the target region in the genome of the cell facilitated by the nuclease, the engineered guide nucleic acid, and the editing sequence.

11. The system of claim 10, wherein the engineered guide nucleic acid and the editing sequence are provided as a single nucleic acid.

12. The system of claim 10, wherein the nucleic acid encoding for the nucleic acid-guided nuclease is codon optimized for *E. coli*.

13. The system of claim 10, wherein the nucleic acid encoding for the nucleic acid-guided nuclease is codon optimized for *S. cerevisiae*.

14. The system of claim 10, wherein the nucleic acid encoding for the nucleic acid-guided nuclease is codon optimized for mammalian cells.

15. The system of claim 10, wherein the nucleic acid encoding for the nucleic acid-guided nuclease is codon optimized for plant cells.

16. The system of claim 10, wherein the nucleic acid-guided nuclease has less than 40% protein identity to SEQ ID NO: 12 and SEQ ID NO: 108.

17. The system of claim 10, wherein the engineered guide nucleic acid comprises any one of SEQ ID NO: 88, SEQ ID NO: 93, SEQ ID NO: 94, and SEQ ID NO: 95.

* * * * *